(12) United States Patent
Hymus et al.

(10) Patent No.: US 9,567,601 B2
(45) Date of Patent: Feb. 14, 2017

(54) PHOTOSYNTHETIC RESOURCE USE EFFICIENCY IN PLANTS EXPRESSING REGULATORY PROTEINS

(71) Applicant: Koch Biological Solutions, LLC, Hayward, CA (US)

(72) Inventors: Graham J. Hymus, Castro Valley, CA (US); Colleen M. Marion, San Mateo, CA (US); T. Lynne Reuber, San Mateo, CA (US); Oliver J. Ratcliffe, Oakland, CA (US); Jeffrey M. Libby, Cupertino, CA (US); Yifan Mao, Cupertino, CA (US)

(73) Assignee: Koch Biological Solutions, LLC, Hayward, CA (US)

( * ) Notice: Subject to any disclaimer, the term of this patent is extended or adjusted under 35 U.S.C. 154(b) by 65 days.

(21) Appl. No.: 14/419,264

(22) PCT Filed: Aug. 2, 2013

(86) PCT No.: PCT/US2013/053483
§ 371 (c)(1),
(2) Date: Feb. 3, 2015

(87) PCT Pub. No.: WO2014/022803
PCT Pub. Date: Feb. 6, 2014

(65) Prior Publication Data
US 2015/0247159 A1    Sep. 3, 2015

Related U.S. Application Data

(60) Provisional application No. 61/679,320, filed on Aug. 3, 2012.

(51) Int. Cl.
C12N 15/82 (2006.01)
C07K 14/415 (2006.01)
A01H 1/02 (2006.01)

(52) U.S. Cl.
CPC ............ *C12N 15/8261* (2013.01); *A01H 1/02* (2013.01); *C07K 14/415* (2013.01); *C12N 15/825* (2013.01); *C12N 15/8242* (2013.01); *C12N 15/8269* (2013.01); *C12N 15/8273* (2013.01)

(58) Field of Classification Search
CPC .................................................. C12N 15/8261
See application file for complete search history.

(56) References Cited

PUBLICATIONS

Shi, X. et al. Journal of Experimental Botany (2012) vol. 63, No. 2; pp. 973-982.*

* cited by examiner

*Primary Examiner* — Russell Kallis

(57) ABSTRACT

Polynucleotides and polypeptides incorporated into expression vectors are introduced into plants and were ectopically expressed. These polypeptides may confer at least one regulatory activity and increased photosynthetic resource use efficiency, increased yield, greater vigor, greater biomass as compared to a control plant.

16 Claims, 147 Drawing Sheets

Figure 1:
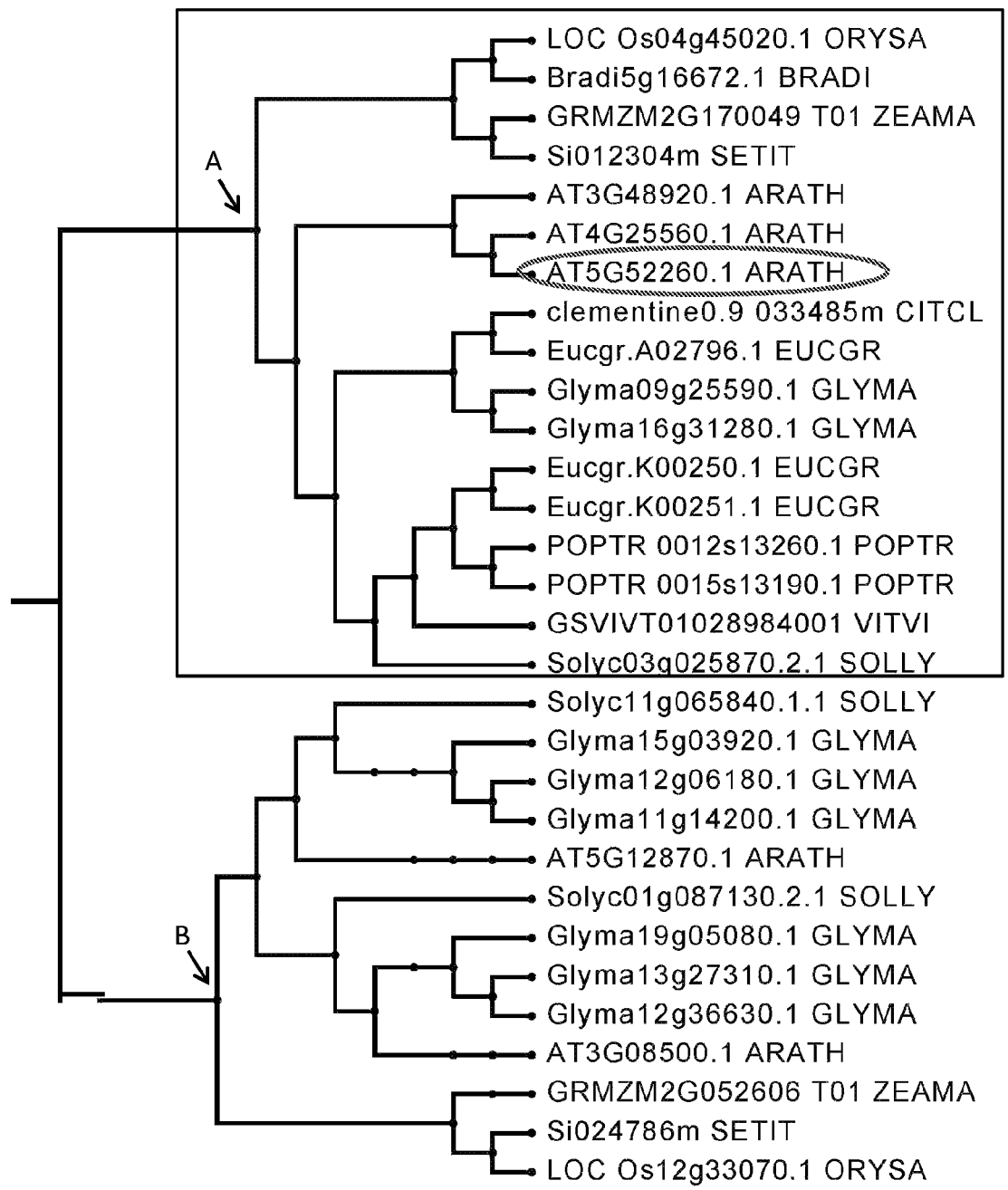

| Sequence | ID | Alignment |
|---|---|---|
| AT3G08500.1 | (54) | ------------------------------MMR----KPDIT--TIRDKGKPNHACG |
| LOC_Os12g33070.1 | (60) | ------------------------------MR-----KPDCG-------GGGGAA |
| GRMZM2G052606_T01 | (56) | ------------------------------MR-----KPECP-------AANSSN |
| Si024786m | (58) | ------------------------------MR-----KPEGP-------AASGGC |
| Solyc01g087130.2.1 | (46) | ------------------------------MR-----KPEHN------NTTMKEKEKE |
| AT5G12870.1 | (44) | ------------------------------MR-----KPEVA---------IAA |
| Glyma19g05080.1 | (48) | ------------------------------MR-----KPDMM----------G-KDKI |
| Glyma13g27310.1 | (50) | ------------------------------MR-----KPDLM----------ANKDKV |
| Glyma12g36630.1 | (52) | ------------------------------MR-----KPDLM----------ANKDKM |
| Solyc11g065840.1.1 | (36) | ------------------------------MR-----KPEFSSSSSSSAKNNNNNN |
| Glyma15g03920.1 | (38) | ------------------------------MR-----KPEAS---------NNNTKN |
| Glyma12g06180.1 | (40) | ------------------------------MR-----KPEVS---------GNNNNN |
| Glyma11g14200.1 | (42) | ------------------------------MR-----KPEVS----------G---KN |
| AT3G48920.1 | (34) | ------------------------------MVFKSEKSNREMK-------------- |
| AT4G25560.1 | (4) | ------------------------------MAKTK--------------------- |
| AT5G52260.1 | (2) | ------------------------------MTKSGERPK----------------- |
| GRMZM2G170049_T01 | (10) | ------------------------------MGCK-ACDKPK--------------- |
| Bradi5g16672.1 | (8) | ------------------------------MGCK-SCQKPK--------------- |
| LOC_Os04g45020.1 | (6) | ------------------------------MGCK-ACQKPK--------------- |
| Si012304m | (12) | ------------------------------MGCK-ACQKPK--------------- |
| Glyma09g25590.1 | (26) | ------------------------------MESK-PLEKAK--------------- |
| Glyma16g31280.1 | (24) | ------------------------------MESQ-PLEKAK--------------- |
| Solyc03g025870.2.1 | (28) | ------------------------------MGCKLAAEKPK--------------- |
| EUCGR.K00250.1 | (18) | ------------------------------MALK-SSERPK--------------- |
| EUCGR.K00251.1 | (20) | ------------------------------MALK-SSERPK--------------- |
| clementine0.9_033485m | (14) | ------------------------------MGCK-SSEKPIAK------------- |
| GSVIVT01028984001 | (30) | ------------------------------MGCN-SLEKSK--------------- |
| EUCGR.A02796.1 | (32) | ------------------------------MGCK-SVEKPK--------------- |
| POPTR_0012s13260.1 | (22) | MPKAFIASITKSKTLFLLYKSPILLIGVLGEMGCK-SSDKPK-------------- |
| POPTR_0015s13190.1 | (16) | ------------------------------MGCK-SSDMPKLK------------ |

FIG. 2A

```
AT3G08500.1      (54) GNN---------------NKPKLRKGLWSPDEDEKLIRYMLTNGQGCWSDIARNAGLLRCGK
LOC_Os12g33070.1 (60) KGGGVLGVAGGNNAAVGGKVRKGLWSPEEDEKLVAYMLRSGQGSWSDVARNAGLQRCGK
GRMZM2G052606_T01(56) AGA--------------AAAKLRKGLWSPEEDERLVAYMLRSGQGSWSDVARNAGLQRCGK
Si024786m        (58) NGGAA------------AAAKLRKGLWSPEEDEKLVAYMLRSGQGSWSDVARNAGLQRCGK
Solyc01g087130.2.1(46) KVN-------------KLGKLRKGLWSPEEDEKLMSYMLRNGQGCWSDIARNAGLQRCGK
AT5G12870.1      (44) STH-------------QVKKMKKGLWSPEEDSKLMQYMLSNGQGCWSDVAKNAGLQRCGK
Glyma19g05080.1  (48) NNN-------------IKSKLRKGLWSPEEDEKLLRYMITKGQGCWSDIARNAGLQRCGK
Glyma13g27310.1  (50) NNN-------------IKSKLRKGLWSPDEDERLIRYMLTNGQGCWSDIARNAGLQRCGK
Glyma12g36630.1  (52) NN--------------IKSKLRKGLWSPEEDERLVRYMLTNGQGCWSDVARNAGLQRCGK
Solyc11g065840.1.1(36) NNN-------------TNVKLRKGLWSPEEDEKLMHYMLTNGQGCWSDVARNAGLQRCGK
Glyma15g03920.1  (38) NNN-------------NSKKLRKGLWSPEEDDKLMNYMLNHGQGCWSDVARNAGLQRCGK
Glyma12g06180.1  (40) NN--------------INNKLRKGLWSPEEDDKLMNYMLNSGQGCWSDVARNAGLQRCGK
Glyma11g14200.1  (42) NN--------------INNKLRKGLWSPEEDDKLMNYMLNSGQGCWSDVARNAGLQRCGK
AT3G48920.1      (34) ----------------SKEKQRKGLWSPEEDEKLRSHVLKYGHGCWSTIPLQAGLQRNGK
AT4G25560.1      (4)  ----------------YGERHRKGLWSPEEDEKLRSFILSYGHSCWTTVPIKAGLQRNGK
AT5G52260.1      (2)  ----------------QRQRKGLWSPEEDEKLLKSFILSRGHACWTTVPILAGLQRNGK
GRMZM2G170049_T01(10) ----------------PNYRKGLWSPEEDQKLRDYILLHGHGCWSALPAKAGLQRNGK
Bradi5g16672.1   (8)  ----------------AHHRKGLWSPEEDQKLRDYIIRYGHSCWSTVPVKAGLQRNGK
LOC_Os04g45020.1 (6)  ----------------VHYRKGLWSPEEDQKLRDFILRYGHGCWSAVPVKAGLQRNGK
Si012304m        (12) ----------------VQYRKGLWSPEEDEKLRDFILRYGHGCWSALPAKAGLQRNGK
Glyma09g25590.1  (26) ----------------PKYRKGLWSPEEDNKLRNHIIKHGHGCWSSVPIKAGLQRNGK
Glyma16g31280.1  (24) ----------------PKYRKGLWSPEEDNKLRNHIIKHGHGCWSSVPIKAGLQRNGK
Solyc03g025870.2.1(28) ----------------QKHKGLWSPDEDDRLKNYMIKHGHGCWSSVPINAGLQRNGK
EUCGR.K00250.1   (18) ----------------PKHRKGLWSPEEDQKLRNYVLKHGHGCWSSVPINTGLQRNGK
EUCGR.K00251.1   (20) ----------------PKHRKGLWSPEEDQRLRNYILNHGHGYWSSVPINTGLQRNGK
clementine0.9_C33485m(14) -------------PKPKHRKGLWSPEEDQRLKNYVLQHGHPCWSSVPINAGLQRNGK
GSVIVT01028984C01(30) ----------------TKPKHRKGLWSPEEDARLRNYVLKYGLGCWSSVPVNAGLQRNGK
EUCGR.A02796.1   (32) ----------------ARHRKGLWSPEEDQRLRNYIHKHGYSCWSSVPINAGLQRNGK
POPTR_0012s13260.1(22) ------------PKLRHRKGLWSPEEDQRLGSYVFQHGHGCWSSVPINAGLQRTGK
POPTR_0015s13190.1(16) ------------PKPKHRKGLWSPEEDQRLRNYVLKHGHGCWSSVPINAGLQRNGK Consensus       (129)                  KGLWSP ED  L     G   W   P         GLQR  GK
```

FIG. 2B

```
AT3G08500.1              (54)  SCRLRWINYLRPDLKRGSFSPQEEDLIFHLHSILGNRWSQIATRLPGRTDNEIKNFWNST
LOC_Os12g33070.1         (60)  SCRLRWINYLRPDLKRGAFSPQEEDLIVNLHAILGNRWSQIAARLPGRTDNEIKNFWNST
GRMZM2G052606_T01        (56)  SCRLRWINYLRPDLKRGAFSPQEELIVSLHAILGNRWSQIAARLPGRTDNEIKNFWNST
Si024786m                (58)  SCRLRWINYLRPDLKRGAFSPQEELIVSLHAILGNRWSQIAARLPGRTDNEIKNFWNST
Solyc01g087130.2.1       (46)  SCRLRWINYLRPDLKRGAFSLQEEELIVHLHSILGNRWSQIAARLPGRTDNEIKNFWNST
AT5G12870.1              (44)  SCRLRWINYLRPDLKRGAFSPQEEDLIIRFHSILGNRWSQIAARLPGRTDNEIKNFWNST
Glyma19g05080.1          (48)  SCRLRWINYLRPDLKRGAFSPQEEEVIIHLHSILGNRWSQIAARLPGRTDNEIKNFWNST
Glyma13g27310.1          (50)  SCRLRWINYLRPDLKRGAFSPQEEDLIVHLHSILGNRWSQIAAHLPGRTDNEIKNFWNST
Glyma12g36630.1          (52)  SCRLRWINYLRPDLKRGAFSPQEEDLIVHLHSILGNRWSQIAARLPGRTDNEIKNFWNST
Solyc11g065840.1.1       (36)  SCRLRWINYLRPDLKRGAFSPQEEEHIIHLHSILGNRWSQIAARLPGRTDNEIKNFWNST
Glyma15g03920.1          (38)  SCRLRWINYLRPDLKRGAFSPQEEELIIHFHSLLGNRWSQIAARLPGRTDNEIKNFWNST
Glyma12g06180.1          (40)  SCRLRWINYLRPDLKRGAFSQQEEELIIHLHSLLGNRWSQIAARLPGRTDNEIKNFWNST
Glyma11g14200.1          (42)  SCRLRWINYLRPDLKRGAFSPQEEEIIHLHSLLGNRWSQIAARLPGRTDNEIKNFWNST
AT3G48920.1              (34)  SCRLRWVNYLRPGLKKSLFTKQEETILLSLHSMLGNKWSQISKFLPGRTDNEIKNYWHSN
AT4G25560.1              (4)   SCRLRWINYLRPGLKRDMISAEEEETILTEHSSLGNKWSQIAKFLPGRTDNEIKNYWHSH
AT5G52260.1              (2)   SCRLRWINYLRPGLKRGSFSEEEEETILTLHSSLGNKWSRIAKYLPGRTDNEIKNYWHSY
GRMZM2G170049_T01        (10)  SCRLRWINYLRPGLKHGMFSPEEEETVMSLHATLGNKWSRIARHLPGRTDNEVKNYWNSY
Bradi5g16672.1           (8)   SCRLRWINYLRPGLKHGMFSQEEEETVMSLHATLGNKWSRIAQHLPGRTDNEVKNYWNSY
LOC_Os04g45020.1         (6)   SCRLRWINYLRPGLKHGMFSREEEETVMNLHATMGNKWSQIARHLPGRTDNEVKNYWNSY
Si012304m                (12)  SCRLRWINYLRPGLKHGMFSREEEETVMSLHAKLGNKWSQIARHLPGRTDNEVKNYWNSY
Glyma09g25590.1          (26)  SCRLRWINYLRPGLKRGVFSKHEKDTIMALHHMLGNKWSQIAQHLPGRTDNEVKNYWHSY
Glyma16g31280.1          (24)  SCRLRWINYLRPGLKRGVFSKHEEDTIMVLHHMLGNKWSQIAQHLPGRTDNEIKNYWHSY
Solyc03g025870.2.1       (28)  SCRLRWINYLRPGLKRGAFSLEEEDIILTLHAMFGNKWSQIAQQIPGRTDNEIKNHWHSY
EUCGR.K00250.1           (18)  SCRLRWINYLRPGLKRGMFTMEEEEIFSLHHLIGNKWSQIAKHLPGRTDNEIKNHWHSY
EUCGR.K00251.1           (20)  SCRLRWINYLRPGLKRGMFTLEEEEIILSLHRLIGNKWSQIAKHLPGRTDNEIKNHWHSY
clementine0.9_033485m    (14)  SCRLRWINYLRPGLKRGVFVNMQEEETILTVHRLLGNKWSQIAQHLPGRTDNEIKNYWHSH
GSVIVT01028984001        (30)  SCRLRWINYLRPGLKRGMFTIEEEETIMALHRLLGNKWSQIAQNFPGRTDNEIKNYWHSC
EUCGR.A02796.1           (32)  SCRLRWINYLRPGLKRGAFTVQEEETILNLHHLIGNKWSQIAQHLPGRTDNEIKNHWHSY
POPTR_0012s13260.1       (22)  SCRLRWINYLRPGLKRGAFSTDEEETILTLHRMLGNKWSQIAKHLPGRTDNEIKNWHSH
POPTR_0015s13190.1       (16)  SCRLRWINYLRPGLKRGTFSAQEEETILALHHMLGNKWSQIAQHLPGRTDNEIKNHWHSY Consensus            (129, 130) SCRLRW NYLRPGLK           E    H  GNKWS I     PGRTDNE KN W  S
```

FIG. 2C

FIG. 2D

```
AT3G08500.1       (54)  TVGNTMR------MDSSSPFNVGPMVNSVGLNQLYDPLMISVPDNGYHQ---------------
LOC_Os12g33070.1  (60)  MWVDSSS------SSSSSSSMQSRP------SIMAAAAGRSYGGLLPLPDQVCGVDTS
GRMZM2G052606_T01 (56)  AMTTTAGLWMVDSSSSCTSSTSPMHQFQRPTTTMAAAVASGSYGGLVFPDQVRGVVAD
Si024786m         (58)  HHAMMTTGLWMVDSSSSTSSSTSPMQSRPPPSAIAAAVAR--SYGGLLPLPDQLRGGTAA
Solyc01g087130.2.1 (46) MDNSSST------TSGSSMQAMVPFN----------------PFPQLDSTSYDIS--------
AT5G12870.1       (44)  QEQGFVN------PSLTHIQTNNPF-----------------------PTGNMIS--------
Glyma19g05080.1   (48)  MDSSSST------SSSSCMQSMHATN----------------MVLTNPFPLLP----NNRYDM
Glyma13g27310.1   (50)  MDSSSSI------SSMQATVLPDQFD----------------PFSMLANNQCDMT--------
Glyma12g36630.1   (52)  MDSSSSI------SSMQAMVLPDQFD----------------PFFMLANNQCDMT--------
Solyc11g065840.1.1 (36) MDSTTSP------SSSSIALNTINIDPLPTLEHTLINMPNGFNAPSYLS----TTQPC
Glyma15g03920.1   (38)  VPMFGSS------PSPSIMQTGTVFN----------------TLIDRLPMLEHGLNMP-----
Glyma12g06180.1   (40)  FNSSSQS------PSMHAMVLNSIID----------------RLPMLEHGLNMP---------
Glyma11g14200.1   (42)  MPMLPML------------------------------------EHGLNMT-------------
AT3G48920.1       (34)  SSTERSS------SSINVGETSNA-----------------QTSSFSP---------------
AT4G25560.1       (4)   RLLENKS------SSPSQESNGNNSH----------------QCSSAPEIP------------
AT5G52260.1       (2)   KFSENPT------SSPSKESNNNMIM----------------NNSNNLP--------------
GRMZM2G170049_T01 (10)  EPRESSS------ADDSSCLTDPHAC----------------RPHAPVPP-------------
Bradi5g16672.1    (8)   GPPESSS------ADDSSCLTGPAGA----------------AAALIRPHAPVLP--------
LOC_Os04g45020.1  (6)   GPVESSS------ADDSSSLTEPAAG----------------LAAVRPHAPVIP---------
Si012304m         (12)  EPVESSS------ADDSSCLTVTEPA----------------RAGAVRPHAPVLP--------
Glyma09g25590.1   (26)  ENLDKSI------AQNDNFFSKSYN-----------------FSKEAYQSSLPLP--------
Glyma16g31280.1   (24)  ENLDKSI------AHNDNFFSQSYN-----------------FSKEACQSSLPLP--------
Solyc03g025870.2.1 (28) EHIEGSL------ADSDQSVYPRE------------------TQKSNLP--------------
EUCGR.K00250.1    (18)  SQEQKEK------TSFDFQRD---------------------GLRSYLP--------------
EUCGR.K00251.1    (20)  SQEQKEK------MSLDFPNG---------------------GPRSCLP--------------
clementine0.9_033485m (14) HHMEKSS---AGSTDQCATQ----------------------GQKSCLP--------------
ENMKGSS.1         (30)  ENMKGSS------STDTDQSIPQMLD----------------CPRVD--TQESPLP-------
EYTKSSA.1         (32)  EYTKSSA------SQIPKIFNPTK------------------EGESSLP--------------
MNMEKPS.1         (22)  MNMEKPS------TDIDRPVLPRMFD----------------YLKEPNRSSLLP---------
MSAEKSS.1         (16)  MSAEKSS------ADINRSV-PQMFE----------------SPNEP--KGSSLLP-------
                                                                                   P
```

FIG. 2E

```
AT3G08500.1            (54)  MGNTVNVFSVNG-LGDYGNT------------------------------ILDPISKRVSVEG
LOC_Os12g33070.1       (60)  P--PPPFFHDHS-ISIKQAYYGSTGAHHHH----HAIATMDGSSLIGDHHHHSSSILFG
GRMZM2G052606_T01      (56)  ---TGGFFHGHAAPAFKHQVAALHGGGYYYGSAPRHHGMTTTTVALEGSGGCFISGEG
Si024786m              (58)  DTSPAGFFHGHA-APFKQQAAVASLHGGYY-------GMGSPHHHGMMAMEGGGGCFMRGEG
Solyc01g087130.2.1     (46)  -GLVGPVNLGQ-FGCSGGD-----------------------GGFLDYGVVETYSMMGLGS
AT5G12870.1            (44)  HPCNDDFTPY---VDGIYGV------------------------------NAGVQG
Glyma19g05080.1        (48)  MTGATGFLDNMA-AACLTQV-----------------GMVDHDHGVVHGTLEPNKTRLG
Glyma13g27310.1        (50)  -NVSADFP-NLT-QIGMVEG------------------------HEGNYGILE--PNKMGLG
Glyma12g36630.1        (52)  -NVSSDFS-NMP-AACLTQI-----------------GMVDGHQGNYGILE--PNKMGSG
Solyc11g065840.1.1     (36)  LVQGGNIVSANG-GNLFYGN------------------------------NHGIFGGNLSMEG
Glyma15g03920.1        (38)  --ASGGYFEGTG-IPCFSQS---------------EVNKLGSCYLENGVFGRSVNIGVEG
Glyma12g06180.1        (40)  ---CSVDNKG-IYLENGG------------------------------VFGSVNIGAEG
Glyma11g14200.1        (42)  --SSGGFFNSKG-PCFSSSQ------------------------------RVFGSVNIGAEG
AT3G48920.1            (34)  ---NLVFSEWLD-HSLLMDQ---------------------------------
AT4G25560.1            (4)   ---RLFFSEWLS-SSYPHTD-------------------------------YS
AT5G52260.1            (2)   ---KLFFSEWIS-SSNPHID-------------------------------YS
GRMZM2G170049_T01      (10)  ---KVMFADWLD-MDYVGGA------------------LPATAPAAPGLLG
Bradi5g16672.1         (8)   ---KVMFADWLD-MDMDYGT---------------------------GLMAPG
LOC_Os04g45020.1       (6)   ---KVMFADWFD-MDYGTSL---------------------------------
Si012304m              (12)  ---KVMFADWLD-MDYGTSL-------------------------------AALG
Glyma09g25590.1        (26)  ---KLLFSEWLS-VDQEY---------------------------------
Glyma16g31280.1        (24)  ---KLLFSEWLS-VDQVDGG---------------------------------
Solyc03g025870.2.1     (28)  ---KVLFSEWLS-LDQFNGQ-------------------------------SS
EUCGR.K00250.1         (18)  ---QIFFAEWLN-QADQGNN-------------------------DFQNSG
EUCGR.K00251.1         (20)  ---NIFFAEWLNQADQGYNV-------------------------IPNYG
clementine0.9_033485m  (14)  ---KLLFAEWLS-LDHANDG---------------------------PTYG
GSVIVT01028984001      (30)  ---KILFAEWLS-LDHIYGQ-----------------------SFANSFEQVAS
EUCGR.A02796.1         (32)  ---TLLFEEWLS-LD-------------------------------LF
POPTR_0012s13260.1     (22)  ---KVMFAEWLS-LDSFASS---------------------------------
POPTR_0015s13190.1     (16)  ---KVMFAEWLS-LESFASL---------------------------------
                                F W
```

FIG. 2F

```
AT3G08500.1         (54) DDWFIPPSENTNVIACSTS------------------------------NNLNLQALDPCFN
LOC_Os12g33070.1    (60) GASVPPLLDHQTILDDDDD---------------HPNKTGSNTTAATLSSNITDNSNSNKN
GRMZM2G052606_T01   (56) MLGVPPLLEPMSAALEQD------------------------------QGQTLMASSGNNNP
Si024786m           (58) LFGVAPLLDAMSAQDQDQA---------------GQALIASSGGNNNPKNNSSNNTTETTT
Solyc01g087130.2.1  (46) DEFSIPSLEGVHNKSTTMGESNNNSNVDFSSNNIVSGANDYDSMIEKKNNTNVNNNNNQ
AT5G12870.1         (44) ELYFPPLECEEGDWYNANI-----------------------------NNHLDELNTNGSGN
Glyma19g05080.1     (48) SDFSLPPLESRSIEDNSST--------------------------PIDHVKSHNNNNHFKNSCFN
Glyma13g27310.1     (50) RDFSLPSLESRSIESNSVP-----------------------------IDVKSHNNHF
Glyma12g36630.1     (52) IDFSLPSLESRSIESNSVP-----------------------------IDVKSHNNHF
Solyc11g065840.1.1  (36) HELYVPPLENVSIEYQNVE-----------------------------NGNFSHHQNNNNPN
Glyma15g03920.1     (38) DMFVPPLENAICSRRETTN-----------------------------SSYFDDDINSI
Glyma12g06180.1     (40) DVYVPPLESVSTTSDHNLK---------------------------------------
Glyma11g14200.1     (42) DMYVPPLESVSTTSDHYNL----------------------------KLESTCNTDTNNSN
AT3G48920.1         (34) ----SPQKSSYVQNLVLPE------------------------------ERGFIGPCGP
AT4G25560.1         (4)  SEFTDSKHSQAPNVEETLS-----------------------------AYEEMGDVD
AT5G52260.1         (2)  SAFTDSKHINETQDQINEE-----------------------------EVMMINNNNYS
GRMZM2G170049_T01   (10) AAGVATASTGDRDQHQVMS-----------------------------MSQGSVQVDGPSGA
Bradi5g16672.1      (8)  LDAGFGAGRCSSPAQGAAS-----------------------------QQGSVQVDGPSCS
LOC_Os04g45020.1    (6)  -------AGTAPGLSYQGSS-----------------------------SVQVDVPCGG
Si012304m           (12) PDAGVFDVSGRSPGQGLSH-----------------------------QGSVQVDGPCG-
Glyma09g25590.1     (26) ------------------------------------------------
Glyma16g31280.1     (24) VNSDDSLVLGNEFDQNSTF-----------------------------QEAIMHMLEENFGE
Solyc03g025870.2.1  (28) SFSFEPCKSNFVYNNNAEL-----------------------------HDILMHSLPMNNDD
EUCGR.K00250.1      (18) DAFDDCINLQDPLVPDLCT-----------------------------SDFGNSYGG
EUCGR.K00251.1      (20) DAFDYRSNIQDSLVHDWCT-----------------------------SDFGNSNGG
clementine0.9_033485m (14) KEGFNNNNNNNNNNNNNNN---------------NNNQNSNLVQDSSDTFMNGYLSNEGAFGG
GSVIVT01028984001   (30) VNSGESVISKDTLDQHDPT-----------------------------FQDNFTHGFLLNEESYVG
EUCGR.A02796.1      (32) --------------------------------------------------NSPGG
POPTR_0012s13260.1  (22) ---GEPVVSKSTFDHNPSF-----------------------------QDTSFMHHYLLEEGAFGG
POPTR_0015s13190.1  (16) ---GEPMDSKTTLDHNTIF-----------------------------QDNFLHDYLLDERAFGG
```

FIG. 2G

```
AT3G08500.1           (54) S-----------------KNLCHSESF---------------KVGNVLGIENGSW-------EI-EN
LOC_Os12g33070.1      (60) NSDNNNNISSSCCISLMNSSSNMIYW-----EGHHQQQQQQHQMLQQQQHM-SR
GRMZM2G052606_T01     (56) KNNSSSNTTDTTTTTLSNNESNVTDTTTKDNTTNTISQVNSGSNNVYWEGARQQYMSRN
Si024786m             (58) VSNNESNITDNNTTNTKDNNINAMSL-------------VNSGSSNVAAVYWEGAHQQYMSRN
Solyc01g087130.2.1    (46) HLMNMSGISD----QSLKVEDYM-----VGFGNHH----HWHGE---SL---
AT5G12870.1           (44) APEGMRPVE-----------------------------------EF---
Glyma19g05080.1       (48) NTDHYHHIQS----------SNNVVVEDL-----FGFGNHG-------QGE----NF---
Glyma13g27310.1       (50) NYGSFNHTDK----------IQGSKVEDL-----IEFGNHG-------QGE----DL---
Glyma12g36630.1       (52) NYGSFKNTDK----------IQGSKVEDL-----IGFGNHG-------QGE----NL---
Solyc11g065840.1.1    (36) NMTNLINTSH----------NFNTCSN------IKVENFGGIGNYWEGD---DL---
Glyma15g03920.1       (38) LNNCNIGIGE----------NKAHDGVEN----LFQQ-----------ELATA
Glyma12g06180.1       (40) ------------------------------------GWWGG-------EF-VS
Glyma11g14200.1       (42) YFDDINSIIL----------NNC--NI------NNSNNIKRAENRAGGVEN-LFQEE
AT3G48920.1           (34) RYLGNDSLPD----------F------------VPNSEFLLDDEISSEI--EF-CT
AT4G25560.1           (4)  QFHYNEMMIN----------NSNWTLNDI----VEGSKCKKQEH-------HIYRE
AT5G52260.1           (2)  SLEDVMLRTD-----------------------FLQPDHEYANYYSSG---DF---
GRMZM2G170049_T01     (10) DV-SLHGFDD----------SGAG---------EFQEHFDAIDHMQAA---GF---
Bradi5g16672.1        (8)  AVDSLHGLGG----------GI-----------DFDAADQMHM-QSGGG--GF---
LOC_Os04g45020.1      (6)  AVDSLHGLGD----------GGF----------DFDDAADHMQ--GGG---GL---
Si012304m             (12) AVDSLHGLGD----------GGIC---------GFDAAVDQMD--VQGG--GF---
Glyma09g25590.1       (26) ---HNRLIH-----------SST----TE----VYNSQIKSTN-QMDGS---DF-MN
Glyma16g31280.1       (24) EY--HNSLIH----------SST----TE----VYNSQLKSTN-QVDGS---DF-IN
Solyc03g025870.2.1    (28) GNGVNQEVLH----------ND-----------IFPPQLKFED-TLSGN---GF---
EUCGR.K00250.1        (18) EY-VGSELSN----------GSASASVSD----MYSSQLKLEM---GS----GF---
EUCGR.K00251.1        (20) EY-VGNELSK----------GSASASVSD----MYSSRLKSEMDQVSGG---GFYLD
clementine0.9_033485m (14) DF-IHNGFNN----------SFVDE--------MLSSRFKFEDHQFSGI---GF-VD
GSVIVT01028984001     (30) EL--HHGLSN----------DSS----SD----MFSPQFKFES-QTPGS---GI-CD
EUCGR.A02796.1        (32) SFTNHAESQD-------------------------------------QISGN---GL-VQ
POPTR_0012s13260.1    (22) DY--QNSLSD----------GSS----GD----IFSSEFKFES-QSPGN---EF--D
POPTR_0015s13190.1    (16) EY--HNSLSD----------GSS----GD----IFSSEFRFES-QSPGN---EF--D
```

FIG. 2H

FIG. 2I

```
AT3G08500.1              (54)  PKIGDWDLDGLI-DNNSSFPFLDFQVD-
LOC_Os12g33070.1         (60)  NVMGEWDLEELM-KDVSSLPFLDFQVE-
GRMZM2G052606_T01        (56)  VMHGEWDLEELM-KDVSSLPFLDFQVE-
Si024786m                (58)  VMHGEWDLEELM-KDVSSLPFLDFQVE-
Solyc01g087130.2.1       (46)  -RIGEFDWEGLL-ANVSSLPYLDFQVE-
AT5G12870.1              (44)  -----WDLDQLMNTEVPSF-YFNFKQSI
Glyma19g05080.1          (48)  -RMGEWDLEGLM-QDISYFPSLDFQV-
Glyma13g27310.1          (50)  -KMGEWDLENLM-QDITSFPFLEF---
Glyma12g36630.1          (52)  -KMGEWDLENLM-QDITSFPFLDF---
Solyc11g065840.1.1       (36)  -KVGEWDLEELM-KDVSPFPFLDFQVE-
Glyma15g03920.1          (38)  TATGEWDFEELMKLDVSSFPFLDFSY-
Glyma12g06180.1          (40)  GRVNHWRVGLGGVNERCFILSLS----
Glyma11g14200.1          (42)  LTIGEWDLEELM-KDVSSFX-------
AT3G48920.1              (34)  SFSDNFLFDGLI-NELRPM--------
AT4G25560.1              ( 4)  ASDCNSSAEFFSPSTTT----------
AT5G52260.1              ( 2)  ------------FINSDQNYV------
GRMZM2G170049_T01        (10)  ------------CDLLSMSDYFGLD--
Bradi5g16672.1           ( 8)  ------------CDLLSMSEFLGIN--
LOC_Os04g45020.1         ( 6)  ------------CDLLSMSEFLGIN--
Si012304m                (12)  ------------CDLLSMTEFLGIN--
Glyma09g25590.1          (26)  CIPGNELRSNFSLTNHGELEGEEYNAIP
Glyma16g31280.1          (24)  CIPGNELCSNFSLTNHAM---------
Solyc03g025870.2.1       (28)  ----EEFMSREFNIND--DVMYI----
EUCGR.K00250.1           (18)  ---GE----------------------
EUCGR.K00251.1           (20)  YFSGDDICSQFDMGSDVNMMYI-----
clementine0.9_033485m    (14)  SISGDDVCSALNMNNDVMYI-------
GSVIVT01028984001        (30)  FVYGDEICSDFNMNGHVMY--------
EUCGR.A02796.1           (32)  CLSGDDLC-ILSKSGCSPEEVISREILK
POPTR_0012s13260.1       (22)  FSSGEDLCREFNFRNIGDVMYI-----
POPTR_0015s13190.1       (16)  FSSGEDLCSDFNLSNISDVMYI-----
```

| | | |
|---|---|---|
| Glyma05g37460.1 | (287) | MGHHSCCNQQKVKRGLWSPEEDEKLIRYITTHGYGCWGEVPEKAG------ |
| Glyma08g02080.1 | (289) | MGHHSCCNQQKVKRGLWSPEEDEKLIRYITTHGYGCWSEVPEKAG------ |
| Glyma11g02400.1 | (291) | MGHHSCCNQQKVKRGLWSPEEDEKLIRYITTHGYGCWSEVPEKAG------ |
| Glyma01g43120.1 | (293) | MGHHSCCNQQKVKRGLWSPEEDEKLIRYITTHGYGCWSEVPEKAG------ |
| GSVIVT01019410001 | (295) | MGHHSCCNQQKVKRGLWSPEEDEKLIRYITTYGYGCWSEVPEKAG------ |
| AT1G63910.1 | (297) | MGHHSCCNQQKVKRGLWSPEEDEKLIRYITTHGYGCWSEVPEKAG------ |
| GRMZM2G325907_T01 | (299) | MGHHSCCNQQKVKRGLWSPEEDEKLIRYITTHGYGCWSEVPEKAG------ |
| LOC_Os08g05520.1 | (301) | MGHHSCCNQQKVKRGLWSPEEDEKLIRYITTHGYGCWSEVPEKAG------ |
| GSVIVT01031341001 | (193) | MGRHSCCYKQKLRKGLWSPEEDEKLMHITKYGHGCWSSVPKLAG------ |
| GSVIVT01017716001 | (155) | MGKHSCCYKQKLRKGLWSPEEDEKLFRYITEHGHGCWSSVPKQAG------ |
| GRMZM2G171781_T01 | (185) | MGRHSCCYKQKLRKGLWSPEEDEKLMNHITKHGHGCWSSVPKLAG------ |
| GRMZM2G127490_T01 | (205) | MGRHSCCYKQKLRKGLWSPEEDEKLMNHITKHGHGCWSSIPKLAG------ |
| LOC_Os05g04820.1 | (191) | MGRHSCCYKQKLRKGLWSPEEDEKLMNHITKHGHGCWSTVPKLAG------ |
| LOC_Os01g18240.1 | (165) | MGRHSCCYKQKLRKGLWSPEEDEKLMNHITKHGHGCWSTVPKLAG------ |
| GRMZM2G017520_T01 | (199) | MGRHSCCYKQKLRKGLWSPEEDEKLMNHITKHGHGCWSTVPKLAG------ |
| GRMZM2G147698_T01 | (179) | MAKQSCCHKKKLRRGLWSPEEDEKLINHVTKYGHGCWSSVPKLAA------ |
| Solyc10g044680.1.1 | (203) | MGRP-CCYKKKLRKGLWCPEEDEKLIKHITKFGHGCWSSVPKLAG------ |
| Solyc01g102340.2.1 | (161) | MGRHSCCYKQKLRKGLWSPEEDEKLRHITKYGHGCWSSVPKQAG------ |
| Glyma19g41010.1 | (163) | MGRHSCCYKQKLRKGLWSPEEDEKLRHITKYGHGCWSSVPKLAG------ |
| Glyma02g00960.1 | (181) | MGRHSCCYKQKLRKGLWSPEEDEKLRHITKYGHGCWSSVPKLAG------ |
| GSVIVT01028235001 | (183) | MGRHSCCYKQKLRKGLWSPEEDEKLRHITKYGHGCWSSVPKQAG------ |
| AT4G01680.2 | (197) | MGRHSCCYKQKLRKGLWSPEEDEKLRYITKYGHGCWSSVPKQAG------ |
| AT1G57560.1 | (135) | MKRHSCCYKQKLRKGLWSPEEDEKLLNYITKHGHGCWSSVPKQAGTFLFI |
| AT1G09540.1 | (137) | MGRHSCCYKQKLRKGLWSPEEDEKLLTHITNHGHGCWSSVPKLAG------ |
| Glyma10g28250.1 | (141) | MGRHSCCYKQKLRKGLWSPEEDEKLLNHITKHGHGCWSSVPKLAG------ |
| Glyma20g22230.1 | (147) | MGRHSCCYKQKLRKGLWSPEEDEKLLNYITKHGHGCWSSVPKLAG------ |
| Glyma19g41250.1 | (151) | MGRHSCCYKQKLRKGLWSPEEDEKLLNYITKHGHGCWSSVPKLAG------ |
| Glyma03g38660.1 | (139) | MGRHSCCFKQKLRKGLWSPEEDEKLLNYITRHGHGCWSSVPKLAG------ |
| Clade consensus | (302) | xGLWxPEEDEKLxxxxxxxxGHGCWSxxPKxAxxxxxx |

Fig. 6A

```
Glyma05g37460.1        (287) ------LLRCGKSCRLRWINYLRPDIRRGRFTPEEEKLIITLHGVVGNR
Glyma08g02080.1        (289) ------LQRCGKSCRLRWINYLRPDIRRGRFTPEEEKLIISLHGVVGNR
Glyma11g02400.1        (291) ------LQRCGKSCRLRWINYLRPDIRRGRFTPEEEKLIISLHGVVGNR
Glyma01g43120.1        (293) ------LQRCGKSCRLRWINYLRPDIRRGRFTPEEEKLIISLHGVVGNR
GSVIVT01019410001      (295) ------LQRCGKSCRLRWINYLRPDIRRGRFSPEEEKLIISLHGVVGNR
AT1G63910.1            (297) ------LQRCGKSCRLRWINYLRPDIRRGRFTAEEEKLIISLHATVGNR
GRMZM2G325907_T01      (299) ------LQRCGKSCRLRWINYLRPDIRRGRFTAEEEKLIISLHAIVGNR
LOC_Os08g05520.1       (301) ------LQRCGKSCRLRWINYLRPDLKRGAFSQQEESLIIELHAVLGNR
GSVIVT01031341001      (193) ------LQRCGKSCRLRWINYLRPDLKRGAFTGQEEKLIVELHEILGNR
GSVIVT01017716001      (155) ------LQRCGKSCRLRWINYLRPDLKRGAFAQDEEDLIIELHAVLGNR
GRMZM2G171781_T01      (185) ------LQRCGKSCRLRWINYLRPDLKRGAFAQDEEDLIIELHAVLGNR
GRMZM2G127490_T01      (205) ------LQRCGKSCRLRWINYLRPDLKRGAFSQEEEDLIIELHAVLGNR
LOC_Os05g04820.1       (191) ------LQRCGKSCRLRWINYLRPDLKRGAFSQEEEDLIIELHAVLGNR
LOC_Os01g18240.1       (165) ------LDRCGKSCRLRWINYLRPDLKRGAFSQEEEDLIVELHAVLGNR
GRMZM2G017520_T01      (199) ------LQRCGKSCRLRWINYLRPDLKRGAFSEEEEDLIVELHAVLGNR
GRMZM2G147698_T01      (179) ------LQRCGKSCRLRWINYLRPDLKRGTFSQEEEDLIIHLHSLLGNK
Solyc10g044680.1.1     (203) ------LQRCGKSCRLRWINYLRPDLKRGTFSQEENLIIQLHSLLGNK
Solyc01g102340.2.1     (161) ------LQRCGKSCRLRWINYLRPDLKRGTFSQDEENLIIELHAVLGNR
Glyma19g41010.1        (163) ------LQRCGKSCRLRWINYLRPDLKRGTFSQEETLIIELHAVLGNR
Glyma02g00960.1        (181) ------LQRCGKSCRLRWINYLRPDLKRGTFSQEEENLIIELHAVLGNR
GSVIVT01028235001      (183) ------LQRCGKSCRLRWINYLRPDLKRGTFSLQEENLIIELHSVLGNR
AT4G01680.2            (197) QIHLLFGLQRCGKSCRLRWINYLRPDLKRGAFSQDEENLIIELHAVLGNR
AT1G57560.1            (135) ------LERCGKSCRLRWINYLRPDLKRGAFSSEEQNLIVELHAVLGNR
AT1G09540.1            (137) ------LQRCGKSCRLRWINYLRPDLKRGAFSPEEENLIVELHAVLGNR
Glyma10g28250.1        (141) ------LQRCGKSCRLRWINYLRPDLKRGAFSQQEENMIVELHAVLGNR
Glyma20g22230.1        (147) ------LQRCGKSCRLRWINYLRPDLKRGAFSQQEENMIVELHAVLGNR
Glyma19g41250.1        (151) ------LQRCGKSCRLRWINYLRPDLKRGAFSQQEENSIIELHAVLGNR
Glyma03g38660.1        (157) ------LQRCGKSCRLRWINYLRPDLKRGAFSQQEENSVELHAVLGNR
AT5G26660.1            (139) ------LQRCGKSCRLRWINYLRPDLKRGAFSQDEESLIIELHAALGNR
Clade consensus        (302) xxxxxxxLxRCGKSCRLRWINYLRPDxxRGxFxxxxExxxIxxLHxxGNX
```

Fig. 6B

Fig. 6C

| | | |
|---|---|---|
| Glyma05g37460.1 | (287) | ------TT-IAQSIDHNSSHQFNYNSNLV--------------------- |
| Glyma08g02080.1 | (289) | ------TT-IAQSIDHNSSDQFNYNSNLV--------------------- |
| Glyma11g02400.1 | (291) | ------SITTTQSVDHQL--QFNFNSNQ---------------------- |
| Glyma01g43120.1 | (293) | ------SMTTTQSVDHHHP-QFNYNSNQ---------------------- |
| GSVIVT01019410001 | (295) | ------APLASSITNTEHSQLGYGSSQ----------------------- |
| AT1G63910.1 | (297) | TTSIATTIEASTTTTSTIDNLHFDGFTD---------------------- |
| GRMZM2G325907_T01 | (299) | ------SAVTAASPPCSTAASDAALGRHLQ--------------------- |
| LOC_Os08g05520.1 | (301) | ------TTSPNNPPCSTATSDH---HHLP---------------------- |
| GSVIVT01031341001 | (193) | ------KLPNSDKSNEKANELN-LVEAEN---------------------- |
| GSVIVT01017716001 | (155) | ------RPTANNSSMELELEPLLNNE------------------------- |
| GRMZM2G171781_T01 | (185) | --AAPTISTERTSGSSDVNPSSTGPLGNLSP-LLSETAQSSMLMP-VYDK |
| GRMZM2G127490_T01 | (205) | --AAPTISTERTSGSSEINPSSAGALGNLSH-LLSETAQSSMLMP-VYDK |
| LOC_Os05g04820.1 | (191) | --AAPTVSTERTSGSSDVNPSSAGALGNLSH-LLSETAQSSMLLP-VYDK |
| LOC_Os01g18240.1 | (165) | --ATPTISNDRTSESSDVDPSSGVALHNLSH-LLSETAQSELLPVKVIK |
| GRMZM2G017520_T01 | (199) | --AAPTTSTERTSESSDVDPSSGGALGNSSHLLLSETAQSPQLP--ALGK |
| GRMZM2G147698_T01 | (179) | --ATTTTVSRRAVFGDVD---------LIPTTTTTIQVP---PP |
| Solyc10g044680.1.1 | (203) | SAIS--MNIEKVSEGSS-ELNIIED--SNYRIKSKSSLVTMTMD-NYP-- |
| Solyc01g102340.2.1 | (161) | SANSNTKNNDKVSESSNNEFNFVENGFSTEKPIKPAVSSMINTLE-RYPL |
| Glyma19g41010.1 | (163) | ---DKTRSQELSNELNLLNSESFKSDEGSYEQRASSSIAPKAYEM-EGSC |
| Glyma02g00960.1 | (181) | ------KAAEVSNELNLLKSESSNRQE----------------------- |
| GSVIVT01028235001 | (183) | ------------------------------------------------- |
| AT4G01680.2 | (197) | ------DKTKPVEKSQQTYLVETDGSSSTTTCS------------------ |
| AT1G57560.1 | (135) | ------KETN----RSDNNN------------------------------ |
| AT1G09540.1 | (137) | ------KDKPTTSNNKRSGNDHK---------------------------- |
| Glyma10g28250.1 | (141) | --NMMPPSTDKSTQKASVGSNEVVSNLVDHHQP-PKTMPNSSSE----RY |
| Glyma20g22230.1 | (147) | --DMMPPSTDKSTQKASVGSNEVS--LVDHHQQQPKIMPNSSSE----RY |
| Glyma19g41250.1 | (151) | ------KPLTADKSNQKA----SNEVS--LIEPPKPKPIS---TTSMP-MDRY |
| Glyma03g38660.1 | (157) | ------KPLTADKSNQKA----SNEVMS-LVEPPKPKPIATTATTSMP-MDRH |
| AT5G26660.1 | (139) | ------VIDQKLTSSEVVKSTGSIN------------------------ |

Fig. 6D

| | | |
|---|---|---|
| Glyma05g37460.1 | (287) | ----LDHFPNQDNNLQTKPPVQEALFSS--------------------------------- |
| Glyma08g02080.1 | (289) | ----LDHFPNHDNNLQTKPPVQETLFSS--------------------------------- |
| Glyma11g02400.1 | (291) | ----LDHYGNQEN-VTAKPPVQETLFSS--------------------------------- |
| Glyma01g43120.1 | (293) | ----LDHYGHQEN-LTAKPPMQETLFSS--------------------------------- |
| GSVIVT01019410001 | (295) | ----LDMVN----QDLMMKQPAQETLFSS-------------------------------- |
| AT1G63910.1 | (297) | ----SPNQLNFTNDQETNIKIQETFFSH--------------------------------- |
| GRMZM2G325907_T01 | (299) | ----TP-FSAAEH--RLDAILSQSIALP--PPKLGSGGGGQESPPLPP-------------- |
| LOC_Os08g05520.1 | (301) | ----PPAFGGADHHLQLDAIINQNLISSLPPKLATGDDSP--PAVPGLPH------------ |
| GSVIVT01031341001 | (193) | -LKPLSTAAEQPSGLVGHFSFQQLNYGPNIGLSSRTGKSAPSVIMPAAAM------------ |
| GSVIVT01017716001 | (155) | --ESLTTIFCRPGEVTG-----RLNYESNP-----------HFPFDLHPGSWL--------- |
| GRMZM2G171781_T01 | (185) | NRAETPNLARPKLPPKELFLEQLTAGHESPSTCHSSGQTLYFPFQQPLGY------------ |
| GRMZM2G127490_T01 | (205) | NRAETPNLARPKVPPKELFLEQLTAGHESPSTCRSSGQTLYFPFQQPLGY------------ |
| LOC_Os05g04820.1 | (191) | NHPETASLPRPKVPPKELFLDQLTAGHESPSSCRSSGPTLYFPFQQPLGY------------ |
| LOC_Os01g18240.1 | (165) | PRTQAPGLARLKVPPKELFLDQLTSGHENLPSCRSSGPIPNFPFQQLLCY------------ |
| GRMZM2G017520_T01 | (199) | HRRETTSLAHLRVPPKELFLDQLVSGHENLTGCRTAGPVPNFPFQQLMCY------------ |
| GRMZM2G147698_T01 | (179) | SFEGGPMLESVKLAVE---LDWPVAG---------DGVTSRPCYLQGGCF----------- |
| Solyc10g044680.1.1 | (203) | SNTTTSAAPLTHKFFLERFVTTHETSTASCNKPLDQLTS-YLSFEKLNYG------------ |
| Solyc01g102340.2.1 | (161) | IHEPNNIAPPTHEFFTTNCKSPDLSNYLSFHN-YSPNTN-ILFNTKTSSS----------- |
| Glyma19g41010.1 | (163) | SSKINTTKNDTNLMSNCSNKDMFLDSYTTSCQPSDLMGN--YPLQIT-------------- |
| Glyma02g00960.1 | (181) | ------------SYTTSCQPSDLMGN--FPIQMSYAT-------- |
| GSVIVT01028235001 | (183) | -----DSNP--------------------- |
| AT4G01680.2 | (197) | ---------TNQNNNTDHLYTGN--FGFQRLSLE---------- |
| AT1G57560.1 | (135) | -STSFSSETNQDLFVK------------KTSDFAEY--SAFQKEESN--------------- |
| AT1G09540.1 | (137) | -SPSSSSATNQDFFLE----------RPSDLSDY--FGFQKLNFN----------------- |
| Glyma10g28250.1 | (141) | PLEVSTTSSTQELFLDRFGT-TTTCHENNNNTSDLVGS-YFSFQHLNYG------------- |
| Glyma20g22230.1 | (147) | PLEVSTTSSTQELFLDRFGTPTTCHHHHNNNTSDVVGS-YFSFQHLNYG------------- |
| Glyma19g41250.1 | (151) | PLEVSSTFKISGGNNNNNSNSTLDRFDSSITSSDMMGMGYFPFQHLNYG------------ |
| Glyma03g38660.1 | (157) | ------------STLDRFDSSITSSDMMGMGYFPFQHLNYG------------ |
| AT5G26660.1 | (139) | NLHDQSMVVSSQQGPWWFPANTTTTN---------------- |

Fig. 6E

```
Glyma05g37460.1        (287) TCPLFIFDTTD-----SLEPGTATDCKSSTVR------------------------------AE
Glyma08g02080.1        (289) TCPLFMFDTTS-----SLEAGTAIDCNSTTVR------------------------------AE
Glyma11g02400.1        (291) TCPLFMFDTS------SLDQGTTTVDTTNNVR------------------------------AE
Glyma01g43120.1        (293) TCPLFMFDTS------SLDQGTTTVDTTNVR-------------------------------TE
GSVIVT01019410001      (295) PAPLFMFDTG------SLDL-----IGDGNGR------------------------------TE
AT1G63910.1            (297) KPPLFMVDTTLP----ILEGMFSENIITNNNKNNDHDDT-----QRGGRE---------------
GRMZM2G325907_T01      (299) HCPFFMFDTSVS----VSPPSP---AAAAAH--------------------------------
LOC_Os08g05520.1       (301) HCPLFMFDTTTTGAGGAISPPPPSSLIPTHLH-------------------------------
GSVIVT01031341001      (193) GAGTVILKTSNGLSISIPHFYWAPHYRTKALNLSIVRLS------------------------QE
GSVIVT01017716001      (155) SQNSISSQLN------------------SQFHSTSISTFL-----------------------QT
GRMZM2G171781_T01      (185) NSESGSSDGANMNSLWFNQSDFNCSTISTVMPPVSPSAL------------------------ST
GRMZM2G127490_T01      (205) NSESGSGDGANMNSLWFNQSDFNCSTISTVMPPASPSAL------------------------ST
LOC_Os05g04820.1       (191) SNECGTGDGASMNSLWFNQNDFNCSTISTVMPPVSPSAL------------------------ST
LOC_Os01g18240.1       (165) NNDFNSMDVGNRNSLWYNQNESSSSTISTVMPPVSPSTL------------------------ST
GRMZM2G017520_T01      (199) SNEFGNKNGASNNSLWFNHNETSGSTISTVMPPVSPSTL------------------------ST
GRMZM2G147698_T01      (179) DMDALQQHCG------------------SIPPVPVVPSAS-----------------------AS
Solyc10g044680.1.1     (203) SNIGLSINSNTNN---LLLNSKNSEMFTHQVNSSIT---------------------------ND
Solyc01g102340.2.1     (161) SAADNIISDHQFNCSTLTNATFSTMSNSILSTTISPLAR------------------------NF
Glyma19g41010.1        (163) --DTLPTNSNSCHWFSQTARPFDMNSEFTITSNVMSILP-PTTTSFLPST
Glyma02g00960.1        (181) NDQCLPNDSNSSHWFSQTGRSFDMNTEFPFNAAVTSINPTPTTNLFLPNN
GSVIVT01028235001      (183) ------PTDSQD-------KASGVSSELNLLKTIN----------------------------
AT4G01680.2            (197) NGSRIAAGSDLGIWIPQTGRNHHHHVDETIPSAVVLPGS-----MFSSGL
AT1G57560.1            (135) ---S-----VSLRNSLSSMIPTQFNIDDGSVSNAGFDT-------------------------Q
AT1G09540.1            (137) --SNLGLSVTTDSSLCSMIPPQFSP--GNMVGSVLQT--------------------------P
Glyma10g28250.1        (141) TTTSMALSSNPN-TSLCFILPSTSSDINNNNSIITSSSM------------------------LP
Glyma20g22230.1        (147) TTTNMSLSANPN-ASLCFVPASTSSDLNNN-STITSS-M------------------------LP
Glyma19g41250.1        (151) --SNMGLTTTPNNTPLCFMPSSTSSQMMSELNSTMLHSM------------------------FP
Glyma03g38660.1        (157) --PNMGLTTTPNNTPLCFIPSSTSSQMMSELNSTMFHSM------------------------FP
AT5G26660.1            (139) QNSAFCFSSSNTTTVSDQIVSLISSMSTSSSPTPMTS--------------------------NF
```

Fig. 6F

| | | | |
|---|---|---|---|
| Glyma05g37460.1 | (287) | HEHQDAVGLS-SETWNSSHHQVHALPP------------LTVSVGLDTS---- |
| Glyma08g02080.1 | (289) | HF-QDAVGLS-TETWNLSHHQVHALPP------------LTVSVGLDTT---- |
| Glyma11g02400.1 | (291) | LF-QDSLGLSSSETWNMSHHQVHALPPQLAA--------TFTATNVIDTT--- |
| Glyma01g43120.1 | (293) | LF-QDSLGLSSTETWNLSHHQVHVLPPQLAA--------TFTAATVIDTT--- |
| GSVIVT01019410001 | (295) | LF-QEVAGLS-SETWQLNQHQVEALPP------------PASYSVGMDT--- |
| AT1G63910.1 | (297) | NVCEQAFLTTNTEEWDMNLRQQEPFQVPTLASHVFNNSSNIDTVIS------ |
| GRMZM2G325907_T01 | (299) | -HLQHPFLTFTAAAMDDNAPMGFHLPPLVDG---MGMGMPAAMDCGAL---- |
| LOC_Os08g05520.1 | (301) | -HHHHPFIASFTAAMAADTPS--YLPPLVDG---MAA-MGAAMDCSLE---- |
| GSVIVT01031341001 | (193) | YISQQMGQVLAGIRTSRNNPYKLQLTYIPRISRDLVWLLDRFVNLY------ |
| GSVIVT01017716001 | (155) | DFSS-TGSVLP-LQSPRG----IQYASASSSSQFSWGLA------------- |
| GRMZM2G171781_T01 | (185) | SMGLNLPPDNPRHGGTGIGSTAVDSFYWDGTNPSSSSSTGSRGSNS------ |
| GRMZM2G127490_T01 | (205) | SMGLNLPPDNSRHGGTGIGSTAVDSFYWDGTNPSSSSSTGSRGSNS------ |
| LOC_Os05g04820.1 | (191) | SMGLNLPPENPRHGGTGIGNTP---FYWDGSNPSSSGSTGSSGSNS------ |
| LOC_Os01g18240.1 | (165) | STGLNPSPDNANSRGTGIHNSQ---FYWDTNNPSSSSSTGSSGNNG------ |
| GRMZM2G017520_T01 | (199) | STGLNRSPDNPHSGGTGIQSTQ---FYWDTANPSSCSSRGSSGSNG------ |
| GRMZM2G147698_T01 | (179) | SSTLTSMAEAEHCSTNNVAAGG--NLPWLELGANAVADAG----------- |
| Solyc10g044680.1.1 | (203) | NILTSP---IAAIASNDSMR-NGSSTSIELQRNSSFFDSN---AFSWG---- |
| Solyc01g102340.2.1 | (161) | NINKFQNWEACTISSNGSNNSNGTSNSIELQSNCSFFDNNAAAAFAWG---- |
| Glyma19g41010.1 | (163) | SFCYKPSLGVPSEDISTASFALNGPNYWEASASNNSNGSNNTSDGS------ |
| Glyma02g00960.1 | (181) | SFCYKPSLAVPSDNVSIP----YGSHYWEASASNNSNSSTELRSSSPL---- |
| GSVIVT01028235001 | (183) | -------------------------------SNNNNNS-------------- |
| AT4G01680.2 | (197) | TGYRSSNLGLIELENSFS-----TGPMMTEHQQIQESNYNNSTFFGN----- |
| AT1G57560.1 | (135) | VCVKPSILLPPPNNTSSTVSGQDHVNVSEPNWE------------------- |
| AT1G09540.1 | (137) | VCVKPSIS-LPPDNNSSSPISGGDHVKLAAPNWEFQTNNNNTSNFFDN---- |
| Glyma10g28250.1 | (141) | SIFPTQHVKLQSNNNNNPSSISSDGVQNWETS------NNTN---KNNGN-- |
| Glyma20g22230.1 | (147) | SIFPTQHVKLQSNNNNPS-ISSDGVQNWETSNLNNSNSTN---KNNGS---- |
| Glyma19g41250.1 | (151) | THVKPTVSLHSNNNNNPSSISSDGVQNWETSTFSNNNN---ASKSNGSSS |
| Glyma03g38660.1 | (157) | THVKPTVSLHSNNNNNNPSSISSDGVQNWEVGTISNNNNNNNASKSNGSSS |
| AT5G26660.1 | (139) | SPAPNNWEQLNYCNTVPSQSNSIYSAFFGNQYTEASQTMN----------- |

Fig. 6G

| Sequence | Position | Alignment |
|---|---|---|
| Glyma05g37460.1 | (287) | ----------------------------NYLPPLIE-HVDNMVP------------ |
| Glyma08g02080.1 | (289) | ----------------------------NYLPPLIE-NVDNMVP------------ |
| Glyma11g02400.1 | (291) | ----------------------------NYLPPLIE-NVENMVPN----------- |
| Glyma01g43120.1 | (293) | ----------------------------NYLPPLIE-NVDNMVPN----------- |
| GSVIVT01019410001 | (295) | ----------------------------NYLPPLVE-NIENMVP------------ |
| AT1G63910.1 | (297) | ----------------------------YNLPALIEGNVDNIVH------------ |
| GRMZM2G325907_T01 | (299) | ----------------------------GHDHRVAGGNNNG--------------- |
| LOC_Os08g05520.1 | (301) | ----------------------------DGQTAAAMAATNGYYQH----------- |
| GSVIVT01031341001 | (193) | ----------------------------LTCGASNSRDER--------------- |
| GSVIVT01017716001 | (155) | ----------------------------DWGLSDQE------------------- |
| GRMZM2G171781_T01 | (185) | ----------------------------MGFEPQSTSTILENSVFPWTDIGQEKDT |
| GRMZM2G127490_T01 | (205) | ----------------------------MGFEPQSTSSILENSVFQWTDIGQEKDT |
| LOC_Os05g04820.1 | (191) | ----------------------------MGFEPQSTTSILENSVFPWTDIGQEKDT |
| LOC_Os01g18240.1 | (165) | ----------------------------LGFELQSTSSLLETNIFPWSDLAPEKDS |
| GRMZM2G017520_T01 | (199) | ----------------------------LGFELQSTSSLLESSVFPWTELTPDKNS |
| GRMZM2G147698_T01 | (179) | ----------------------------GHVVGS-------------------C-- |
| Solyc10g044680.1.1 | (203) | ----------------------------TADYDKSEKEVNIHPSVP---------- |
| Solyc01g102340.2.1 | (161) | ----------------------------SAGATAAAD----CTGKS--------- |
| Glyma19g41010.1 | (163) | ----------------------------RELTTTSSKNSVLSSWG---------- |
| Glyma02g00960.1 | (181) | -----------------NIFSSWGLADCGTSTTKEAQIHMMEN------------- |
| GSVIVT01028235001 | (183) | ----------------------------GNLNWGLTMEEN--------------- |
| AT4G01680.2 | (197) | ----------------------------SNSGTTSHLNNP--------------- |
| AT1G57560.1 | (135) | ----------------------------GGFSWSIPNSSTSSSQVKPNH------- |
| AT1G09540.1 | (137) | --MQLQSSTN------YLDSTWGVAESMKIVNINKEAQVVP-------------- |
| Glyma10g28250.1 | (141) | --MQLQSCTN------FIDNTWGVGESMKVVNINKDADQMP-------------- |
| Glyma20g22230.1 | (147) | CSIQLQSGSTNFLDHSSTITWGLQ-AESATKADKDAHVVVPL------------- |
| Glyma19g41250.1 | (151) | CSIQLQS--------------SSTITWGLQQAESATKAE--------------- |
| Glyma03g38660.1 | (157) | ----------------------------NNNPLVDQHHHH--------------- |
| AT5G26660.1 | (139) | |

Fig. 6H

| | | | |
|---|---|---|---|
| Glyma05g37460.1 | (287) | ----IEVQSCTIDEQGDIALECLQ----------------------RQG----------LNEW-VE |
| Glyma08g02080.1 | (289) | ----IEVQSCTMDEQGDIALECLQ----------------------RRG----------LNEWMVE |
| Glyma11g02400.1 | (291) | ----MEVQSCSIDEEGEMALECLR----------------------RQD----------LNEW-VE |
| Glyma01g43120.1 | (293) | ----MEVQSCSIDEEGEMALECLR----------------------RQG----------LNEW-VE |
| GSVIVT01019410001 | (295) | ----MQVQSCSIDEEGEIALECLQ----------------------RQE----------LNDW-VE |
| AT1G63910.1 | (297) | ----NENSNVQDGEMASTFECLK----------------------RQE----------LSYDQWD |
| GRMZM2G325907_T01 | (299) | ----QAAAAAGMANGCCYGQLQ----------------------KQQEEEQQPSLGQEDQW |
| LOC_Os08g05520.1 | (301) | ----HQKHQQLEIELEEEQRQLG----------------------HHHQHHHEHEHENHQW |
| GSVIVT01031341001 | (193) | ----ITGGFQSK-KDLEKTSSGQVC----------------AIEFS-YDFVNRSDTKGL |
| GSVIVT01017716001 | (155) | ----GKLGDN-KQLEHLSTP----------------------SF SNWNKNCFSDYKCF |
| GRMZM2G171781_T01 | (185) | RAHLVAELKWP-D-----SFAETTT----------------AMQNQS--QTLYDDVIKAE |
| GRMZM2G127490_T01 | (205) | RAHLVEELKWP-DLLHGTFAETTT----------------AMQNQS--QTLYDDVIKAE |
| LOC_Os05g04820.1 | (191) | RVHLVEELKWP-DLLHGTFAEATT----------------AMQNQS--QSLYDDVIKAE |
| LOC_Os01g18240.1 | (165) | QAQLEEELKWP-DLLHGTF SEMPA----------------PMQNLS--QSLYEDVVKAE |
| GRMZM2G017520_T01 | (199) | QVHLGEELKWP-DLLHGTFTDTPA----------------TMQNLS--QSLYEDVIKAE |
| GRMZM2G147698_T01 | (179) | YAGALDELRWS-EYFDSAFQAAES----------------QQGALQPGQCVYGGKDDVP |
| Solyc10g044680.1.1 | (203) | ----DPDDIKWS-EYLHTQLLPG----NAITN------DQIT--QDLYS--AKSS |
| Solyc01g102340.2.1 | (161) | ----EREEIKWS-EYLQTPFSLGVNNTIDTHHQHQIPSHHELYDGETKSK |
| Glyma19g41010.1 | (163) | ----LTEETKWS-EYLQNPMLMLA------------APESLCNQIRPATHLV |
| Glyma02g00960.1 | (181) | ----HNTEEAKWD-EYLHNPISMLASSVQN--------QAPESLCNDIKTSMHLV |
| GSVIVT01028235001 | (183) | ----NSNLMLP-------------------------TIR---------- |
| AT4G01680.2 | (197) | ----QNPFTISN----------------HSNSSLYSDIKSETNFF |
| AT1G57560.1 | (135) | ----GMEEMKWSEEYLN----------------ESLFSTQVYVKSETDFN |
| AT1G09540.1 | (137) | ----NFEEIKWS-EYLNTPFFIG------STVQSQTSQPIYIKSETDYL |
| Glyma10g28250.1 | (141) | LQAEQEDLKWS-EYLN-TPFILGNNTTQNHQIQTSQSIYTEVIKPETGFI |
| Glyma20g22230.1 | (147) | LQAEQEDLKWS-EYLN-TPFILGNNTAQNHQIHTSQSIYSEV-KPETGFI |
| Glyma19g41250.1 | (151) | QSSEQEDIKWS-EYLNNTPFSLGTMSVQ-HQTTNSLYSSDEVKPETTGFI |
| Glyma03g38660.1 | (157) | ----QEDIKWS-EYLNNTPFYLGTTPVQ-HQTTNSLYSSDEVKPETTGFI |
| AT5G26660.1 | (139) | ----QDMKSWASEILHYTEHNQSS-----------ETVIEAEVKPDIANYY |

Fig. 6I

```
Glyma05g37460.1      (287) TQQQCPNFLFWD----SVEGQLGGEELAPNSSNVEANTLSP-FPCSL-
Glyma08g02080.1      (289) TQQQCPNFLFWD----SVEGQLGGEELAPNSSNVEANMLSP-FPSSL-
Glyma11g02400.1      (291) NQQQCPSFLFWDNI--NVEGQLRGEELAPNTSNMGNNTLSP-FPSSL-
Glyma01g43120.1      (293) HQQQCPNFLFWDSI--NVEGQLGGEELAPNTSNMGNNTLSP-FPSSL-
GSVIVT01019410001    (295) SQQ-CPSFLFWD----QVEGHLGGEEIAPPSSNMGA-VLSS-YSTSL-
AT1G63910.1          (297) DSQQCSNFFFWDNLNINVEGSSLVGNQDP-SMNLGSSALSSSFPSSF-
GRMZM2G325907_T01    (299) DDESARHLLMWDD-----DQELTPSNLEAMESTAHSLLFMG--PNDHT
LOC_Os08g05520.1     (301) DEEEAQHLLMWD------QEVLTSSNLEAMQSGAHSLLFMG--PNDHD
GSVIVT01031341001    (193) SYFLMNICNGNKLLFIFFHGSMVWNKVSFDVYSSSMLHLFRIHRL---
GSVIVT01017716001    (155) CLYRSHACPS------YCIG---YDQIQIQGNG---------------
GRMZM2G171781_T01    (185) SQFNIEGICASWFQNQQPQQQLQVAPDMYDKDLQRMQLSFENI-----
GRMZM2G127490_T01    (205) SQFSMEGICASWFQNQQPQQQLQATPDMYDKDLQRMQLSFENI-----
LOC_Os05g04820.1     (191) SQFNMEGICASWFQNQQPQQQLQAASDMYDKDLQRLPLSFEHI-----
LOC_Os01g18240.1     (165) SQFNMEGLCAAWSQNLLPQQHLPVVSDMYDKDLQRMSLSFENI-----
GRMZM2G017520_T01    (199) SQFNIEGLCAAWSQNLQPQQHL-QVSDLYDKDLQRMSLSFENI-----
GRMZM2G147698_T01    (179) VHFDVHGGLSNWC-----------------------------------
Solyc10g044680.1.1   (203) IQFTTQGSLLQNQQ---QQPSLQTANIY-NKHYQRISDSFGQFS----
Solyc01g102340.2.1   (161) TQFMTQGSWLQNQTP--QTSSLQTAELYSNNNFQRLPAVYGQFS----
Glyma19g41010.1      (163) PDNTLGSIIVPDSKDQQQQQSQNSSIF-SKDTQKLTAAFG--HI----
Glyma02g00960.1      (181) PD-TLGAMLPHN--HTKQQEQSQTSSFF-SKDIQKLRAAFG-------
GSVIVT01028235001    (183) ----------------------CGGVF-GPSAIELPIQC---------
AT4G01680.2          (197) GT-------------EATNVGMWP-CNQLQPQQHAYG--HI-------
AT1G57560.1          (135) ---SNIAFPWSQ---SQACDVF-PKDLQRMAF SFGGQTL--------
AT1G09540.1          (137) ANVSNMTDPWSQN--ENLGTTETSDVF-SKDLQRMAVSFG-QSL----
Glyma10g28250.1      (141) IDESCTSNWHHHQ---PPPAFQLSDIY-SKDLQRFSVTFG-QTL----
Glyma20g22230.1      (147) TDESCAT-WHHYQ---NQTPAFQLSDIY-SKDLQRFSVTFG-QTL---
Glyma19g41250.1      (151) ADESST-SWHHSQ---H---FQPSEIY-TKDLQRFSVAFG-QTL----
Glyma03g38660.1      (157) ADESSTMSWHHSQ---HN---FQPSEIY-TKDLQRFSVAFG-QTL---
AT5G26660.1          (139) WRSASSSSSPNQE---AATLLHDANVEVYGKNLQKLNNMVFDQSL---

Fig. 6J
```

```
Si0305506m              (462)  ----------------------------------MCGGAILSDLYSPVRRTVTAGDLWA----------------------ESGSRRSGKNQKRSS
Si0305514m              (464)  ----------------------------------MCGGAILSDLYSPVRRTVTAGDLWA----------------------ESGSRRSGKNQKRSS
AT1G72360.2             (444)  ----------------------------------MCGGAVISDYIAPEKIARSSGKSSW----------------------------RSNG
GRMZM2G009598_T01       (361)  ---------------MGTNPHLQELAAASAVAASEPP------------------------------------PRARVVR
Si037209m               (363)  ---------------MGPNPSLQQLAAAAEVAMTASEPPP-----------------------------------PPRARVVR
AT2G46310.1             (309)  ---------------MKSRVRKSKYTVHRKITSTPFDGFP------------------------------------KIVK
AT3G16630.1             (311)  ---------------MERRTRRVKFTENRTVTNVAATPSN-----------------------------------GSPRLVR
AT4G27950.1             (315)  ----------MMMDEFMDLRPVKYTEHKTVIRKYTKKSS---------------------------MERKTSVRDSARLVR
AT5G53290.1             (317)  ----------MDEYIDFRPLKYTEHKTSMTKYTKKSS-----------------------------EKLSGGKSLKKVS
AT4G11140.1             (307)  ---------------------METEKKV---------------------------------------------SLPRILR
AT4G23750.1             (313)  ----------MEAEKKMVLPRIKFTEHKTNTTTIVSELT---------------------------NTHQTRILR
Solyc08g081960.1.1      (337)  ----------MDQQTMLSSGVKYTEHRKQITMVRPAPP-----------------VTFNGRRRSSEMNAAGPRVVR
Solyc03g007460.1.1      (319)  ----------MDYHSLCPIKYTEHRNVIRKVTKPSL-----------------VKSKKLSEAAKSSQLNPSVPRTVR
Solyc06g051840.1.1      (321)  ----------MDHHSSLCPIKYTEHKRTIRKVTKPSV---------------IKPKKVSDVRKSSEYNPRTVR
Glyma13g08490.1         (327)  ----------MEPQNRSNSILCKYTEHETVTKKHMKSKN-----------------------NTSLSPKVIS
Glyma14g29040.1         (329)  ----------MEQQNSILCKYTEHQTVMKKHMKSKD-------------------------NTFCSPKVIS
Glyma05g37120.1         (331)  ----------MASSSIKNTHHLNRTKLFMEEDT-------------------------LLKKKRHYPKLIR
Glyma08g02460.1         (333)  ----------MASSSIKHTHHLNRTKLFMKEET-------------------------LLKKKHHYPKIIR
Glyma04g41740.1         (323)  ----------MEDSILCKHTVHRSVTKKLISPKK----------------------SSQTNSSTQTERRIVR
Glyma06g13040.1         (325)  ----------MEDSILCKHTVHHTVTKKLISPKK----------------------SSQTNSTTERRIVR
Glyma01g43350.1         (335)  ----------MTAPPSKYTHHSKLLIPSEEDPP-------------------------KHPYPRLVR
Glyma11g02140.1         (385)  ----------MTAPPTKYTHHTKLLIPPEEDPP-------------------------KHHYPRLVR
LOC_Os06g06540.1        (353)  ---------MVEVIVEKKARRIVRGRWHVEASNEAAAAAP--------------------AVAAPAPRVVR
Si008428m               (359)  -------------------MVEAAHKAA-------------------------------AIRKVVR
GRMZM2G328197_T01       (355)  ----------MPEAATVVYTERKRKIKKEPAETA------------------------TVPKLVR
GRMZM2G429378_T01       (357)  --------------MVEAAAVSRSRPKIKQEP-----------------------AETTAICKLVR
LOC_Os01g946870.1       (347)  --------------------------------------------------------MSRSRTVR
GRMZM2G151542_T01       (349)  --------------------------------------------------------MSRSRTVR
GRMZM2G160971_T01       (351)  --------------------------------------------------------MSRPRTVR
LOC_Os01g12440.1        (339)  MMMWPLEMEEGFVALKRTEHVEVTSLAVAVEATPSAKGGKGKVVVGGGGAGGVGPTRVR
GRMZM2G044077_T01       (341)  --MWPMEEEVFVTVRRTEHVDVTSRAVVVAA---------------------GRAAVAGPRTVR
GRMZM2G142179_T01       (343)  --MWPM-EEEMFLAVKRTEHVEVISRAMDSAP-----------------------AAGPRTVR
Si002247m               (345)  --MWAM-EEEMFVAVRRTEHVEVTSRAVEVAP-----------------------AAAAGPRTVR Small Consensus         (442)                                                                                Xx
```

FIG. 8A

| | | | |
|---|---|---|---|
| Si030506m | (462) | WEFDEADDDFEADFED--FEDCSSVEEVDFGHEEKDFQINS----------------------------------- | |
| Si030514m | (464) | WEFDEADDDFEADFED--FEDCSSVEEVDFGHEEKDFQINS----------------------------------- | |
| AT1G72360.2 | (444) | VF--DCSIYDFDGNFDE-------------------LESDEP---------------------------------- | |
| GRMZM2G009598_T01 | (361) | ILVHDADATDSSSSEDE------APPLLPRRRSR----------------------------------------- | |
| Si037209m | (363) | ILVHDADATDSSSSEDE------APPPPRRAR------------------------------------------- | |
| AT2G46310.1 | (309) | IIVTDPCATDSSSDEEN------DNKSVAPRVKRYVDEIRF---------------------------------- | |
| AT3G61630.1 | (311) | ITVTDPFATDSSSDDDD------NNNVTVVPRVKRYVKEIRFC-------------------------------- | |
| AT4G27950.1 | (315) | VSMTDRDATDSSSDEEE------FLFPRRRVKRLINEIRVEPSSSSIG--------------------------- | |
| AT5G53290.1 | (317) | ICYTDPDATDSSSDEDE------EDFLFPRRRVKRFVNEITVEPSCNNV------------------------- | |
| AT4G11140.1 | (307) | ISVTDPYATDSSSDEEEVDFDALSTKRRRVKKYVKEVVLDSV--------------------------------- | |
| AT4G23750.1 | (313) | ISVTDPDATDSSSDDEEE-EHQRFVSKRRRVKKFVNEVYLDSGAVVTGS------------------------- | |
| Solyc08g081960.1.1 | (337) | ITVTDADATDSSSDEGE------QGFYGRQRVRKFVNEVRIEQSSHCNGSVNGVLRNGSSS | |
| Solyc03g007460.1.1 | (319) | ISVTDPDATDSSSDEED------LLFGRRRVKKYINEISIETAVKCEV--------------------------- | |
| Solyc06g051840.1.1 | (321) | ICVTDPDATDSSSDEDE------LFGRKRVKRYISEISIESPSVNDV--------------------------- | |
| Glyma13g08490.1 | (327) | ILMTDQYATDSSSDEER------VTSRRRIKRYVNRIELQP--------------------------------- | |
| Glyma14g29040.1 | (329) | IS-IDPYATDSSSDEEN------VMRRRRVKRYVNRIELQ---------------------------------- | |
| Glyma05g37120.1 | (331) | IRVTDADATDSSSDDDE------PSVSSTRRRVKYFVNEITIQGGGGGG------------------------- | |
| Glyma08g02460.1 | (333) | IRVTDADATDSSSDDDE------PSMSSTRRRVKNFVNEITIQGGGGGG------------------------- | |
| Glyma04g41740.1 | (323) | ISYTDPDATDSSSDEEG------FPLVRKRMKRYVNQIEIE-------------------------------- | |
| Glyma06g13040.1 | (325) | ISYTDPDATDSSSDEEG------FPFVRQRMKRYVNQIEIE-------------------------------- | |
| Glyma01g43350.1 | (335) | ITVTDIEATDSSSDEEQ------HTSTRHRHRKFVNEISIESSCASEN-------------------------- | |
| Glyma11g02140.1 | (385) | ITVTDIDATDSSSDEEEEQTYHCNSSTRHRHRKFVNEISIESCSSEN-------------------------- | |
| LOC_Os06g06540.1 | (353) | VLCRDHDATDSSGDDDG------EDDAPRRARLLVHEIHVARQPVAM--------------------------- | |
| Si008428m | (359) | IFCDDRDATDSSGDEAE------AGAGVATPRGVRKFVKEIRMEQRRAI------------------------- | |
| GRMZM2G328197_T01 | (355) | VFCDDLDATDSSGDDEA------AASGGVAARGARKFILEIFTEGH--------------------------- | |
| GRMZM2G429378_T01 | (357) | VFCDDRDSTDSSGDEAA------AGGGAGAAGARKFLVEISVEKHQP-------------------------- | |
| LOC_Os01g46870.1 | (347) | IFWDDPDLTDSSGEDEG------CGGRRVGSMVRELPPAQMPVAQAGFAPAAAAAAAA | |
| GRMZM2G151542_T01 | (349) | IFWDDPDLTDSSGDDEG------CGARRVGRMVRELAPAPAPAA---LPV---------------------- | |
| GRMZM2G160971_T01 | (351) | IFWDDPDLTDSSSEEEG------CGTRRVGRMVRELPPMAGAAAAAPVPDQ---------------------- | |
| LOC_Os01g12440.1 | (339) | VFCDDFDATDSSSDEDE------EEVTARRRVKRYVQEIRLQRAAAVAVPPVKVKGEEVFP | |
| GRMZM2G044077_T01 | (341) | VFCDDYDATDSSGDEAE------EEEEKKAARRRVKRYVQEIHLERAAKEEE---EA---------------- | |
| GRMZM2G142179_T01 | (343) | VFCDDNDATDSSGDEAE------GAAARRRVKRYVQEIRLQRAVPVKE---EA------------------- | |
| Si002247m | (345) | VFCDDYDATDSSGDEDD------EEAAVAARRRVKRYVQEIRLERAVKEAP---AA---------------- | |
| Small Consensus | (442) | XxxxDxxxTXSSXxX | |

FIG. 8B

| Si030506m | (462) | ----SIFMKFNDHTAKV------------ARRKRKT------------QYRGIRRRPWGK |
|---|---|---|
| Si030514m | (464) | ----SIFMKFNDHTAKV------------ARRKRKT------------QYRGIRRRPWGK |
| AT1G72360.2 | (444) | FVFSSTHKHHASGSASD------------GKKKQSS------------RYKGIRRRPWGK |
| GRMZM2G009598_T01 | (361) | ----GGSSSLSVRRRVMEP------------AGASSAV------------RFRGVRRRPWGR |
| Si037209m | (363) | ----VGSSSVGARRRVMEA------------AGANPPV------------RFRGVRRRAWGR |
| AT2G46310.1 | (309) | ----CDEDDEPKPARK------------AKKKSPAAAAENGGDLVKSVVKYRGVRQRPWGK |
| AT3G61630.1 | (311) | ----QGESSSTAARKGKHKE------------EESVVVE------------DDVSTSVKPKKYRGVRQRPWGK |
| AT4G27950.1 | (315) | ----DVSASPTKDRKRINVDS------------TVQKPSV------------SGQNQKKYRGVRQRPWGK |
| AT5G53290.1 | (317) | ----VIGVSMKDRKRLSSSDETQSPASSRQRPN------------NKVSVSGQIKKFRGVRQRPWGK |
| AT4G11140.1 | (307) | ----VSDKEKPMKKKR------------KKRVVTV------------PVVVTATRKFRGVRQRPWGK |
| AT4G23750.1 | (313) | ----CGQMESKKRQKRAVKSE------------STVSPVV------------SATTTTGEKKFRGVRQRPWGK |
| Solyc08g081960.1.1 | (337) | ETAPVVAAAPKRRKKTAGATT------------AASKLKV------------NHVKKFRGVRQRPWGK |
| Solyc03g007460.1.1 | (319) | ----SSGNGKTVNKRAPEPLQ------------TKQKPMK------------VQPPPSAGAARKFRGVRQRPWGK |
| Solyc06g051840.1.1 | (321) | ----KTLSSGNGKKRVAEGSQ------------AKQKALK------------GKEVADKTVRKFRGVRQRPWGK |
| Glyma13g08490.1 | (327) | ----AIKSVATRKRHVGDA------------TKLRPPQ------------VKVKNSGSVKKFRGVRQRPWGK |
| Glyma14g29040.1 | (329) | ----PAFKPVTTRKRHAGDAA------------TLRKPPA------------KVTNSCRKFRGVRQRPWGK |
| Glyma05g37120.1 | (331) | ----CVNVSRKRRFKAGAGAP------------SCRRRTG------------AKKFRGVRQRPWGK |
| Glyma08g02460.1 | (333) | ----DVNVVSKKRRFKSGAGAP------------LCRRKTG------------AKKFRGVRQRPWGK |
| Glyma04g41740.1 | (323) | ----TAAAEKVVRKRPAGE------------PCRRPAK------------LHSGKKFRGVRRPWGK |
| Glyma06g13040.1 | (325) | ----TAAAEKVVRKRPAGE------------ACRRPAK------------LHSGKKFRGVRRPWGK |
| Glyma01g43350.1 | (335) | ----DGAASRKRIRRRSTATP------------KGRASDT------------RLVSNGKKFRGVRRPWGK |
| Glyma11g02140.1 | (385) | ----DGVVSRKRIRRRSTTTP------------KATRASD------------TRRVSDGKKFRGVRRPWGK |
| LOC_Os06g06540.1 | (353) | ----SPAAASSSQRRRVGP------------MKRTESAVDATMDATAAAPERKFRGVRKRPWGK |
| Si008428m | (359) | ----TSSAPAGRVAPGGG------------GKRKLPG------------VPAAARAAEPSYRGVRRRPWGK |
| GRMZM2G328197_T01 | (355) | ----RKGCNATATIPAPGG------------GKRKAPA------------TTLAPEEPRYRGVRRRPWGK |
| GRMZM2G429378_T01 | (357) | ----RCNAMAPAGRAAGG------------GKRKAAA------------AGTPAEPRYRGVRRRPWGR |
| LOC_Os01g46870.1 | (347) | LPEQCSGGDGDMGRRVVGGGCTVGV------------GRRRLTK------------DGGPGAPSTKFRGVRRRPWGK |
| GRMZM2G151542_T01 | (349) | -PDQCNPGDGDRGRKAGVAGPGVCS------------GARRRLA------------KGAGGAASTKFRGVRRRPWGK |
| LOC_Os01g12440.1 | (351) | ----CNAGDGDRGRRLGVAAPGACS------------GARRRLA------------KTGPSTKFRGVRRRPWGK |
| GRMZM2G160971_T01 | (339) | AAVSAKMAEAAKARVVLAA------------GRKRKAG------------GVDGAEPRFRGVRRRPWGK |
| GRMZM2G044077_T01 | (341) | ----EATAAASLGAVLPGP------------KRKRKPD------------GEASEPRFRGVRRRPWGK |
| GRMZM2G142179_T01 | (343) | ----ASARAVAGERPRPLALP------------GRKRKSD------------GAGAGAEPRFRGVRRRPWGK |
| Si002247m | (345) | ----KAAASSAAAAARTKLVLP------------GRKRKAD------------GAEPRFRGVRRRPWGK |
| AP2 Consensus | (441) | XRGXRxRxWGX |

FIG. 8C

| | | |
|---|---|---|
| Si030506m | (462) | WAAEIRDPCKGVRVWLGTYNTAEEAAARAYDVAARRIRGKKAKVNF--PDTITASAKRL--- |
| Si030514m | (464) | WAAEIRDPCKGVRVWLGTYNTAEEAAARAYDVAARRIRGKKAKVNF--PDTITASAKRL--- |
| AT1G72360.2 | (444) | WAAEIRDPIKGVRVWLGTFNTAEEAAARAYDLEAKRIRGAKAKLNF--PN------------ |
| GRMZM2G009598_T01 | (361) | WAAEIREPHNRRRLWLGTFDTAEEAANAYDAANIRFRGVSATTNF--PAARYS--------- |
| Si037209m | (363) | WAAEIRDPHGSRRIWLGTFNSAEEAAAAYDVANIRFRGASAHTNF--PPARYLL-------- |
| AT2G46310.1 | (309) | FAAEIRDPSSRTRLWLGTFATAEEAAIGYDRAAIRIKGHNAQTNF--LT------------- |
| AT3G61630.1 | (311) | FAAEIRDPSSRTRIWLGTFVTAEEAAIAYDRAAIHLKGPKALTNF--LT------------- |
| AT4G27950.1 | (315) | WAAEIRDPEQRRRIWLGTFATAEEAAIVYDNAAIKLRGPDALTNF--TVQ------------ |
| AT5G53290.1 | (317) | WAAEIRDPEQRRRIWLGTFETAEEAAVVYDNAAIRLRGPDALTNF--SIP------------ |
| AT4G11140.1 | (307) | WAAEIRDPSRRVRVWLGTFDTAEEAAIVYDNAAIQLRGPNAELNF--P-------------- |
| AT4G23750. | (313) | WAAEIRDPLKRVRLWLGTYNTAEEAAMVYDNAAIQLRGPDALTNF--SVTPTTATEKKA--- |
| Solyc08g081960.1.1 | (337) | WAAEIRDPLRRVRLWLGTYDTAEEAAMVYDHAAIQLRGPDALTNF--AT------------- |
| Solyc03g007460.1.1 | (319) | WAAEIRDPARRVRLWLGTYDTAEEAAMVYDNAAIKLRGPDALTNF--STPAKAE-------- |
| Solyc06g051840.1.1 | (321) | WAAEIRDPARRVRLWLGTYDTAEEAAMVYDNAAIKLRGPDALTNF--IT------------- |
| Glyma13g08490.1 | (327) | WAAEIRDPVQRVRIWLGTFETAEEAALCYDNAAIMLRGPDALTNF--GIRSKETLEKEER-- |
| Glyma14g29040.1 | (329) | WAAEIRDPVQRVRIWLGTFKTAEEAALCYDNAAITLRGPDALTNF--GRSR----------- |
| Glyma05g37120.1 | (331) | WAAEIRDPLRRVRLWLGTYDTAEEAAIVYDNAAIQLRGADALTNF--VT------------- |
| Glyma08g02460.1 | (333) | WAAEIRDPSRRVRLWLGTYDTAEEAAIVYDNAAIQLRGADALTNF--IT------------- |
| Glyma04g41740.1 | (323) | WAAEIRDPARRVRLWLGTYDTAEEAAMVYDNAAIRLRGPDALTNF--LT------------- |
| Glyma06g13040.1 | (325) | WAAEIRDPARRVRLWLGTYDTAEEAAMVYDNAAIRLRGPDALTNF--VTPPKRDSPS----- |
| Glyma01g43350.1 | (335) | WAAEIRDPSRRVRLWLGTYDTAEEAAIVYDNAAIRLRGPDALTNF--IT------------- |
| Glyma11g02140.1 | (385) | WAAEIRDPARRVRLWLGTYDTAEEAAIVYDNAAIKLRGPHALTNF--IT------------- |
| LOC_Os06g06540.1 | (353) | YGAEIRVSQQSARVWLGTFDTAEEAARMYDSEARRLRGPSATTNF--PMTPAA--------- |
| Si008428m | (359) | YAAEIRDPHKNARVWLGTFDTAEEAAREYDSAARRLRGPSATTNF--PA------------- |
| GRMZM2G328197_T01 | (355) | YAAEIRDPHKGERLWLGTFDTAEEAARRYDSETRRLRGPSAITNF--PA------------- |
| GRMZM2G429378_T01 | (357) | YAAEIRDPHKGERLWLGTFDTAEEAARRYDSETRRLRGPSAITNF---------------- |
| LOC_Os01g46870.1 | (347) | FAAEIRDPWRGVRVWLGTFDTAEEAARVYDNAAIQLRGPSATTNF--SA------------- |
| GRMZM2G151542_T01 | (349) | FAAEIRDPWRGVRVWLGTFDTAEEAARVYDAAAVQLRGANATTNF--SA------------- |
| GRMZM2G160971_T01 | (351) | FAAEIRDPWRGVRVWLGTFDTAEEAARVYDTAAIQLRGANATTNF--SA------------- |
| LOC_Os01g12440.1 | (339) | YAAEIRDPWRRVRVWLGTFDTAEEAAKVYDTAAIQLRGRDATTNF--NQSGDSASLDV---- |
| GRMZM2G044077_T01 | (341) | YAAEIRDPWRRVRVWLGTFDTAEEAAKVYDSAAVQLRGRDATTNF--QQQVD--------- |
| GRMZM2G142179_T01 | (343) | YAAEIRDPWRRVRVWLGTFDTAEEAAKVYDSAAIQLRGADATTNFEHAAVPVPVPDEVAG |
| Si002247m | (345) | YAAEIRDPWRRVRVWLGTFDTAEEAAKVYDSAAIQLRGPDATTNF--EQVDDPVPTEVAE |
| AP2 Consensus | (441) | XXXAEIRxxxxxxxRXWLGTXxxXAEEAAxxxYDxxxxxxxXGxxAxxNF |

FIG. 8D

```
Si030506m              (462) --PGRVPRPAKKVMSQESLKFSSASEHAISAG--SSTDATVVKIELSESDSPLPMSSAWL
Si030514m              (464) --PGRVPRPAKKVMSQESLKFSSASEHAISAGS-STDATV-VKIELSESDSPLPMSSAWL
AT1G72360.2            (444) --ESSGKRKAKAKTVQQVEENHEADLDVAVVSSAPSSSCLDFLWEENNPDTLLI-DTQWL
GRMZM2G009598_T01      (361) ---PPPKPAKPI-----------------ISLTPEPGKV------------IILPPVPV--KPTFP
Si037209m              (363) ---PLEPAKPI------------------ISLTPGPGKV------------IILPPVPV--KSTVP
AT2G46310.1            (309) ---PPPSPTTEVLPETPV-----------IDLETVSGCD-SARESQ-----ISLCSPTSVL--RFSHN
AT3G61630.1            (311) ---PPTPTPV-------------------IDLQTVSACD-YGRDSR-----QSLHSPTSVL--RFNVN
AT4G27950.1            (315) ---PEPEPVQE------------------QEQEPESNMSVSISESMDDSQHLSSPTSVLNYQTYVS
AT5G53290.1            (317) ---PQEEEEEEPEPVIEEKPVIMTTPTTSSSESTEEDL----QHLSSPTSVLNHRSEEI
AT4G11140.1            (307) ---PPVTENVEEAS---------------TEVKGVSDFIIGGGECL-----RSPVSVL--ESPFS
AT4G23750.1            (313) ---PPPSPVKKKKKNNKSK----------KSVTASSSTSRSSSNDC----LCSPVSVLR-SPFAV
Solyc08g081960.1.1     (337) ---PP------------------------ATKISCSSYN-SGEESH----NDQRSPKSVLRCASTSF
Solyc03g007460.1.1     (319) ---PEPEPEPEPE----------------ISALSHSGYE-SGNESR----NIPSPTSVL--RCTMS
Solyc06g051840.1.1     (321) ---PPIKEKPE------------------VNVASNSGYE-SGDESH----NLSSPTSVL--RFRSS
Glyma13g08490.1        (327) KELDEKEEIRTEKPEMKVVVKPEIETALVSCFYDSADEFC---LNLSSPTSVL--RFNES
Glyma14g29040.1        (329) ---PEETPEKEEMPEMKVVVKPETQVSVSVSGCYDSGDECC---LNLSSPTSVL----QFS
Glyma05g37120.1        (331) ---PPRENRK-------------------TGYC-SGEESR-NNDLRSPTSVLGCRSVYE
Glyma08g02460.1        (333) ---PPPENRK-------------------TGYC-SGEESR-NNDDLRSPTSVLG-RCSVS
Glyma04g41740.1        (323) ---PPQRESPSQATTVAV-----------TEEEASGSGYD-SGDDHCQH--NLSSPTSVLHFRSNSE
Glyma06g13040.1        (325) ---PSPPPAAAETPAEVCEMKVVVTEEASGSGYDSSEDHCH--HNLSSPTSVLQFRSNSS
Glyma01g43350.1        (335) ---PPATCHNTDPP---------------PEAESVRGKDEGKDDE-----YSSVSMSRVKAESP
Glyma11g02140.1        (385) ---PP------------------------SGEETHCNSKNIFSPTSVLH-CCSLS
LOC_Os06g06540.1       (353) ---PSPPPSRA------------------TYAGAASGYDESSSDESQ---LVGSPVSVLRPMPARA
Si008428m              (359) ---APPKPVRVVPPPQAIP----------AVVADLSSAEESSDESQ----LVGSPVSVL--PAMP
GRMZM2G328197_T01      (355) ---PPTPSDRVP-----------------AVRELSSAEESDSDETH----TVSSPVSVL--QEAMP
GRMZM2G429378_T01      (357) ---PATPDDRVPLPAPALSLHGVAAVGEHSSAEFESCDESQ----LVVGSPVSVI--RAMPD
LOC_Os01g46870.1       (347) ---STNSAG--------------------AQDPVAVGYE-SGAESS----PAVSSPTSVLRKVPSLC
GRMZM2G151542_T01      (349) ---SAAINCGSGSGAGAGQD---------PATTPAAGYE-SGAESS-------PTSVLRKVPSLS
GRMZM2G160971_T01      (351) ---AANSGSRAG-----------------QRDPATPGYE-SGTESS----PAASSPTSVLRKVPSLS
LOC_Os01g12440.1       (339) ---PPEVAERVPQPPGAS-----------KNASPATSYD-SGEESH----AAAASPTSVL--RSFPP
GRMZM2G044077_T01      (341) ---PERLSQPAA-----------------SKSAATSTYD-SGEESV----TAVASPTSVL--RSFPP
GRMZM2G142179_T01      (343) RLPQPFPAPASKN----------------ASSSATSSYD-SGEESH----AAAASPTSVL--RTFPP
Si002247m              (345) RLPQPFPAAASK-----------------NASSSATSYD-SGEESH----AAAASPTSVL--RSFPP
```

FIG. 8E

```
Si030506m              (462) DAFELNQLDGSKYLEAGGKETTEETDHEN------------------------GVTADMVFGNGEV------
Si030514m              (464) DAFELNQLDGSKYLEAGGKETTEETDHEN------------------------GVTADMVFGNGEV------
AT1G72360.2            (444) EDIIMGD---------------ANKKHEPNDSEE-----------------------ANNVDASL-------
GRMZM2G009598_T01      (361) VQVKEVG---------------GSWGGLVKGARS----------------------------------------
Si037209m              (363) LQVKVKE---------------EGGSCDGQGEEGSS--------------------------------------
AT2G46310.1            (309) DETEYRT---------------EPTEEQNPF-------------------------------------------
AT3G61630.1            (311) EETEHEI---------------EAIELSPERKST----------------------VIKEEESSAGLVFPD---
AT4G27950.1            (315) EEPIDSL---------------IKPVKQEFLEPEQEPI------------------SWHLGEGNTNTNDDS---
AT5G53290.1            (317) QQVQQPF---------------KSAKPEPGVSNAPWW-------------------HTGFNTGLGESDDS----
AT4G11140.1            (307) GESTAVK---------------EEFVGVSTAEIV----------------------VKKEPSFNGSD-------
AT4G23750.1            (313) DEFSGIS---------------SSPVAAVVKEEPS---------------------MTTVSETFSD--------
Solyc08g081960.1.1     (337) DESQNNE---------------EAEAESLPILPSDIRD------------------KNDISMSENFCDL-----
Solyc03g007460.1.1     (319) QSESGSG---QVHVSEECPSVQGSMECEQTVQPFVQCAAEPLIPSAIPQDVEECQGETSMI-------------
Solyc06g051840.1.1     (321) ESSEEAE---------------PGLEDIKENCTVL---------------------VEEEPNSEHLEC------
Glyma13g08490.1        (327) AELEKQY---------------EPFPGRTEAHTV----------------------LEECQGQTVSF-------
Glyma14g29040.1        (329) AEPYKPD---------------EPFPDMPWDDVF----------------------NFPVMFDEPLSHL-----
Glyma05g37120.1        (331) EAESVTA---------------NATGNDVVDESVTVVANDVVGPSSECEYSCVSEDSNNDKL------------
Glyma08g02460.1        (333) EEAAVTAN--------------DVFGGSSECEYS----------------------------------------
Glyma04g41740.1        (323) SDQKSEQ---------------VLRECEGEGEFLAL--------------------DNMPLPA-----------
Glyma06g13040.1        (325) EENSESQ---------------QKAEQVLRECEGE---------------------------------C-----
Glyma01g43350.1        (335) -----------------------------------------------------------------------
Glyma11g02140.1        (385) EEAESVT---------------AKDDDYSSVSEN----------------------------------------
LOC_Os06g06540.1       (353) TAKKEAK---------------EEDDSAPDILGISAGDGL----------------ISPFTCDVLNFPP-----
Si008428m              (359) GETTDDA---------------VAPLALKPTDATD---------------------STAKKDASPFS-------
GRMZM2G328197_T01      (355) GETAAAV---------------GPPAPKPTDDAA----------------------DPAAAKKDAPRGDGGLSHF
GRMZM2G429378_T01      (357) ETARATL---------------PPKIADAAAGCA----------------------TKKDAPDGRGGLSP----
LOC_Os01g46870.1       (347) SLAEDKD---------------DYEAGPCEPATAAGSN------------------LTVLEEEELGEFVP----
Glyma2G151542_T01      (349) SLAEDDS---------------DAPAAQRRSL------------------------AVLEEEELGEFVP-----
Glyma2G160971_T01      (351) SLAEDDS---------------CAAPCEPAAGCRSL--------------------AVLEEEELGQFVP-----
LOC_Os01g12440.1       (339) SAVVATADTANKKQPPPPLVVRETDESV----------------------------DVFGCSFSDDGG------
GRMZM2G044077_T01      (341) SADAGGT---------------RSKAAARNPETGDS--------------------TIVFGCPFS---------
GRMZM2G142179_T01      (343) SSAAADA---------------TCKKKPAPAAETDEST------------------GVGGSRSSVYAYPFFANDDC
Si002247m              (345) SAVAEDTCGKKPAPAAQPAYRAPETDESS---------------------------VDGSVFGCPFTGDDC---
```

FIG. 8F

FIG. 8G

```
Si030506m              (462) ----------------------QDGV-NIGGLWS----------------------FD
Si030514m              (464) ----------------------QDGV-NIGGLWS----------------------FD
AT1G72360.2            (444) ----------------------GNDM---GLWS-------------------------
GRMZM2G009598_T01      (361) ----------------------------------------------------VE
Si037209m              (363) ----------------------------------------------------VE
AT2G46310.1            (309) ------------PLGVIGDFSSWD----------------------VDEF-FQ
AT3G61630.1            (311) -NETEDFEFGLIDDF--ESSPWD-----------------------VDHF-FD
AT4G27950.1            (315) ------------AEEY----YSSE----------------------IKEIGSS-FN
AT5G53290.1            (317) ------------TMNIEDELTSSS----------------------------IK
AT4G11140.1            (307) ------------GSGF----SSWH----------------------VEDH-FQ
AT4G23750.1            (313) ------------GFDFGSGLSSWH----------------------MEDH-FQ
Solyc08g081960.1.1     (337) ------------TTDYGFGSSSWP----------------------EEDF-FQ
Solyc03g007460.1.1     (319) LCNDSLDFGNDFLFN-DADF-AEFGSFD------------------DLGDLGMD
Solyc06g051840.1.1     (321) ---NDDL--F-SSWDFTNDSVLDPEICKFDDSFLDLGALEVDNY-FK
Glyma13g08490.1        (327) ------------EEKF----LPSAT--------------------LCQVDDY-FQ
Glyma14g29040.1        (329) ------------LGDY----SSFL----------------------ARTTQC-VN
Glyma05g37120.1        (331) ------------NENLDLGFTSWH---------------------RECDN-FQ
Glyma08g02460.1        (333) ------------DLGF----TSWH----------------------RECDN-FQ
Glyma04g41740.1        (323) SSIVLADSLIDF--------DKAC----PPPS---------------TLCQVDDF-FQ
Glyma06g13040.1        (325) --------------------PEAC----PSPS---------------SLCQVDDF-FQ
Glyma01g43350.1        (335) --------------------NRDF----------------------------FQ
Glyma11g02140.1        (385) --------------------DFGF----KSWH---------------TDRNRDF-FQ
LOC_Os06g06540.1       (353) --------------------DGDL-GDLPSWT---------------EVDGF-FS
Si008428m              (359) --------------------DDGHLGDLPMWP---------------GEDGCGFS
GRMZM2G328197_T01      (355) --------------------ALDL-GSLPMWP---------------GVDGCQFS
GRMZM2G429378_T01      (357) --------------------ALDL-GSLPMWP---------------GVDGCRFS
LOC_Os01g46870.1       (347) --------------------DAGA----TSSG---------------EAQDY-FQ
GRMZM2G151542_T01      (349) --------------------SDDA----PSWA---------------ASPVQENDY-FQ
GRMZM2G160971_T01      (351) --------------------SDDA----PSWA---------------ASPVQENDY-FQ
LOC_Os01g12440.1       (339) --------------------LDDA----PSPA---------------AAQVDDF-FQ
GRMZM2G044077_T01      (341) --------------------EEECPSDAVRWR---------------QVDEL-FQ
GRMZM2G142179_T01      (343) --------------------SDAEAASPARWQ---------------QVDDF-FQ
Si002247m              (345) --------------------ENKC----WA-----------------------MA
```

FIG. 8H

```
Si030506m                (462)  DVPMDSGVY----------------
Si030514m                (464)  DVPMDSGVY----------------
AT1G72360.2              (444)  -------------------------
GRMZM2G009598_T01        (361)  EVGGG--------------------
Si037209m                (363)  EVGGA--------------------
AT2G46310.1              (309)  DHLLDK-------------------
AT3G61630.1              (311)  HHHHS--FD----------------
AT4G27950.1              (315)  DLDDS-----LISDLLLV-------
AT5G53290.1              (317)  DMGSTFSDFDDSLISDLLVA-----
AT4G11140.1              (307)  DI-GD--LF---GSDPVLTV-----
AT4G23750.1              (313)  DI-GD--LF---GSDPLLAV-----
Solyc08g081960.1.1       (337)  DF-GD--VF---GSDPLVAL-----
Solyc03g007460.1.1       (319)  DFSQDNSVVDYSSVDSLLAI-----
Solyc06g051840.1.1       (321)  DI-GD--FS---SVDVLMAL-----
Glyma13g08490.1          (327)  DI-----LL---GSDPLVAL-----
Glyma14g29040.1          (329)  NKSSVCEMK---CRRLFPCRR----
Glyma05g37120.1          (331)  DI-GD--LF---VWDPLVAL-----
Glyma08g02460.1          (333)  DIGGD--LF---VWDPLVAL-----
Glyma04g41740.1          (323)  DI-----LL---ASDPLVLL-----
Glyma06g13040.1          (325)  DI-----LF---ASDPL--------
Glyma01g43350.1          (335)  DI-DD--LF---VSDPLLAL-----
Glyma11g02140.1          (385)  DI-DD--LF---VSDPLLAL-----
LOC_Os06g06540.1         (353)  DVGGD-DLF---AAEPFPAL-----
Si008428m                (359)  DIGDD--FF---AAEPLPAV-----
GRMZM2G328197_T01        (355)  DI-SDDDLF---ALSGPGAPN----
GRMZM2G429378_T01        (357)  DI-GDDDLF-----SLPAL------
LOC_Os01g46870.1         (347)  DL-RD--LF---PLNPLPAIF----
GRMZM2G151542_T01        (349)  DL-RD--LF---PLNRLPAIF----
GRMZM2G160971_T01        (351)  GL-RD--LF---PLNPLPAIF----
LOC_Os01g12440.1         (339)  DI-TD--LF-----QIPVV------
GRMZM2G044077_T01        (341)  DI-TD--LF---QIDPLPVA-----
GRMZM2G142179_T01        (343)  DI-TD--LF---QIDPLPVV-----
Si002247m                (345)  A------------------------
```

FIG. 8I

FIG. 11A

| | | | |
|---|---|---|---|
| LOC_Os03g09170.1 | (544) | ------------------------------ | --CSEQSA------------------------- |
| GRMZM2G113060_T01 | (546) | ------------------------------ | --SFAYPC-------PGVEQQSQCAA------- |
| Solyc12g056980.1.1 | (526) | ------------------------------ | --PSPSPS------VSPSFDLQSSSLSTSFLYESFSSTSQP- |
| Bradi4g29010.1 | (528) | ------------------------------ | --SHPSPT------SPFSFPHA-------AYQGYPY- |
| LOC_Os08g31580.1 | (530) | ------------------------------ | --HPGLPP------APANFSSA-------GVHGFHY- |
| GRMZM5G852704_T01 | (540) | PYSSVLPQDSYYL---PATSSYTALPPPPLAPTATSFSQLPLPLPQSSSSYASPASSSCPT |
| Si008385m | (542) | VYHSALPQDSYYYQPAAAASSCTALPPPPAPTTTSFSQLPLPPCSSSYAMPIA-PYQT |
| Bradi3g58980.1 | (538) | SMTQD------------------------- | --SSYITT----NPSPYASFATSPVPTTALPPLYSSAG--- |
| LOC_Os02g51670.1 | (536) | MSQDSYMPTPSYP----------------- | --TSSITTAAATTSSFSQLPPLYSSQYHAASPAASA---- |
| GRMZM2G029323_T01 | (532) | SSYT-------------------------- | --TSPLPT----PTSSPFSQLPPLYSSPYAASTASG---- |
| Si017760m | (534) | DSYMPTPSYATFA----------------- | --TSPLPTAAATSSSSFSQLPPLYSSPYAASAASG---- |
| Glyma18g02170.1 | (512) | ------------------------------ | --SITYPS----FSSFSSSPNFSSTTSYEQKVSITPN--- |
| POPTR_0002s09480.1 | (520) | SPPSTSSNRFS------------------- | --FSPQPPQQHQQSLFNPDGCCSTSTTYPFSTGLSFNDPM |
| POPTR_0005s16690.1 | (522) | SLPSLPSTSYDYF----------------- | --FSFSTPSHLQQQQQPFLYPDVCCSTSTAYPFSTGFSINDAM |
| Glyma05g31370.1 | (506) | ------------------------------ | --SPLIPS-------NSLP-------------- |
| Glyma08g14600.1 | (508) | ------------------------------ | --SSSLES------QPCSFSSNSLPTSYP---- |
| GSVIVT01009007001 | (524) | ------------------------------ | --SDFYSP------ISTQYPDGCSTSTTHVISQGFSSHDLQG |
| Glyma04g11290.1 | (516) | ------------------------------ | --TSYSPSPNNYSPSLYSNG---LSSIPNTTQNLIGFGQGQ |
| Glyma06g11010.1 | (518) | ------------------------------ | --FPSSPS------LPNLYSNG----LSSNTQSLIGFGQAQ |
| Glyma13g01930.1 | (510) | ------------------------------ | --SPLLPP------HPSFSTYTPSAYLFQNQQPLIGFEQQ- |
| Glyma14g34590.1 | (514) | SFNFPS------------------------ | --SSLLSP------HPNFYTHTPPPSYLLQSQQSLIGFEQP- |
| Solyc04g054910.2.1 | (498) | ------------------------------ | ---------------------------------GFSGYDQMG |
| GSVIVT01002262001 | (504) | ------------------------------ | --NSLISS------YPNLDLSFCSPTSTQMFSNGFLDYNQMG |
| POPTR_0005s07900.1 | (500) | PFSSHPSCFYNN------------------ | --CFPVTS------HPNLDLNFYTPTSTQMFSNGFSGYNQMG |
| POPTR_0007s05690.1 | (502) | YSFSSYPSCYHNN----------------- | --AFSLPA-------PISY-------------- |
| AT1G22190.1 | (490) | ------------------------------ | --AFSLPP------LPGYYPDSTFLTQPFSYGSDLQQ---- |
| AT1G78080.1 | (492) | S----------------------------- | --SFPVPN-------TSFGVN------------ |
| AT2G22200.1 | (494) | ------------------------------ | --SNPKPL------TPNFIPNNDQVLPVSN---- |
| AT5G65130.1 | (496) | ------------------------------ | |

FIG. 11B

```
LOC_Os03g09170.1       (544)  ----SSLLAGANYLTPAQVLHVQAQLQRLRRPGAASG--------------------CLAAA
GRMZM2G113060_T01      (546)  ----AGSFLGAGGLTPAQLLQVQSRLRFLRRPAAAGG-----------------------
Solyc12g056980.1.1     (526)  ----NMSSIGLNQAQIYLSQQVMPAVTFQNNNQY-------------------ASYLGP
Bradi4g29010.1         (528)  ----GVQAQAQAELSPAEMHYIQARLHLQRQTGPPGH-------------------LGP
LOC_Os08g31580.1       (530)  ---------MGPAQLSPAQIQRVQAQLHMQRQA--QSG----------------LGP
GRMZM5G852704_T01      (540)  SSVDAAASGLALNHLGPAQIHQIHSQLLAQRRQQHQRG----------QLAAAFLGP
Si008385m              (542)  LSMDAAAGLALNHLSPAQIQQIQAQLLRQQQRGLVA--------------SLLGP
Bradi3g58980.1         (538)  ----VNGPIGLAHLGPAQIQQIQAQFIAQQQRGMGL--------------AGSFLGP
LOC_Os02g51670.1       (536)  ----TNGPMGLITHLGPAQIQQIQAQFLAQQQQRALA--------------GAFLRP
GRMZM2G029323_T01      (532)  ----VAGPMGLNQLGPAQIQQIQAQLMFQHQQQRGLH--------------AAFLGP
Si017760m              (534)  ----VTGPMGLNQLGPAQIQQIQAQFMQQQQRGLHA--------------AFLGP
Glyma18g02170.1        (512)  ----HASSIKLNQLTPSQMFQIQARIQVPRGQ---------------------FLSP
POPTR_0002s09480.1     (520)  GLQQPSSSIGLNHLTPTQVHQIQTQMHHNNLSYLQAY-----------QQPQILKFLSP
POPTR_0005s16690.1     (522)  GLQQPSSSIGLNHLTPNQIHQIQTQIHQNNSHSYLRT-----------CQQPQILKFLSP
Glyma05g31370.1        (506)  ----SSNQIRLNQLTQDQILQIQAQIHIQQQHVAGGQ-------------AHLGP
Glyma08g14600.1        (508)  ----SSNQIKLNQLTPDQIVQIQAQIHIQQQQHVAQ--------------TQTHLGP
GSVIVT01009007001      (524)  FE--HSGPIGLNHLTPSQIHQIQAQIQLQQHHNHM-------------------P
Glyma04g11290.1        (516)  ----PTSLVGLNHLTPSQISQIQAQIQIQNHSNT------------------LSFLGP
Glyma06g11010.1        (518)  ----PTSLVGLNHLTPSQISQIQAQIQIQAQQHQNRS-----------NTLSFLGP
Glyma13g01930.1        (510)  ----PSSLLGLNHLSTSQISQIQAQAQNSLS---------------------LNFLGP
Glyma14g34590.1        (514)  ----PSSLLGLNHLSPSQISQIQAQIEAQQSQNQNPH---------------SLNFLGP
Solyc04g054910.2.1     (498)  --------ILQIQAQIQFQNQQQQLQL---------------------LHQQQQ
GSVIVT01002262001      (504)  LE--QTRSIGLNHITPAQILQIQAQIHWQQQHN--------------LNFLGP
POPTR_0005s07900.1     (500)  FE--QTGPIGLNHLTPSQILQIQAKIHFQQQQQQKME--NLATTTSQFVHNQRASNFLAP
POPTR_0007s05690.1     (502)  FE--QTGPIGLNHLTPSQILQIQAKIHLQQQQQQQMANHAPAPTSQLVHNQRISNFLAP
AT1G22190.1            (490)  ----GSDLHSFSH-----------------------------------HLSP
AT1G78080.1            (492)  ----TGSLIGLNNLSSSQIHQIQSQIHHPLPPTHHNN---------------NNSFSNLLSP
AT2G22200.1            (494)  ----KSMPLGLNQLTPYQIHQIQNQLNHRRST------------------ISNLSP
AT5G65130.1            (496)  ----QTGPIGLNQLTPTQILQIQTELHLRQNQSRRA------------------GSHLLTA
```

FIG. 11C

```
LOC_Os03g09170.1       (544) PPL-PMKRHGA------------VAVAAAAARAPVKLYRGVRQRHWGKWVAEIRLPRNRTRLWL
GRMZM2G113060_T01      (546) AAQ-PMKRQGV------------PQQAPLPARPAVSKLYRGVRQRHWGKWVAEIRLPRNRTRLWL
Solyc12g056980.1.1     (526) KPV-SMKQTGS------------P-------PKPPKLYRGVRQRHWGKWVAEIRLPKNRTRLWL
Bradi4g29010.1         (528) RAQ-PMKPAST------------AAATP---PRPQKLYRGVRQRHWGKWVAEIRLPRNRTRLWL
LOC_Os08g31580.1       (530) RAQ-PMKPASA------------AAPAAAAARAQKLYRGVRQRHWGKWVAEIRLPRNRTRLWL
GRMZM5G852704_T01      (540) QAQ-PMKHAGA------------PP------LAAAKLYRGVRQRHWGKWVAEIRLPRNRTRLWL
Si008385m              (542) RAQ-PMKQAGA------------VAPP----STASKLYRGVRQRHWGKWVAEIRLPRNRTRLWL
Bradi3g58980.1         (538) RGTTPMKQYSG------------SPPL----GAQSKLYRGVRQRHWGKWVAEIRLPKNRTRLWL
LOC_Os02g51670.1       (536) RGQ-PMKQSGSPPRAGPFAAVAG--------AAQSKLYRGVRQRHWGKWVAEIRLPKNRTRLWL
GRMZM2G029323_T01      (532) RAQ-PMKQSGS------------P-------PAQSKLYRGVRQRHWGKWVAEIRLPKNRTRLWL
Si017760m              (534) RAQ-PMKQSGS------------PPLA----PAQSKLYRGVRQRHWGKWVAEIRLPKNRTRLWL
Glyma18g02170.1        (512) KPI-PMKHVRA------------SPS-----SKPTKLYRGVRQRHWGKWVAEIRLPKNRTRLWL
POPTR_0002s09480.1     (520) KPI-PMKQIGT------------P-------PKATKLYRGVRQRHWGKWVAEIRLPKNRTRLWL
POPTR_0005s16690.1     (522) KPV-PMKQMGT------------P-------SKSTKLYRGVRQRHWGKWVAEIRLPKNRTRLWL
Glyma05g31370.1        (506) KRV-PMKHAGT------------A-------AKAAKLYRGVRQRHWGKWVAEIRLPKNRTRLWL
Glyma08g14600.1        (508) KRV-PMKHAGT------------A-------AKPTKLYRGVRQRHWGKWVAEIRLPKNRTRLWL
GSVIVT01009007001      (524) API-PMKQVGV------------P-------PKPTKLYRGVRQRHWGKWVAEIRLPKNRTRLWL
Glyma04g11290.1        (516) KPI-PMKHVGM------------P-------PKPTKLYRGVRQRHWGKWVAEIRLPKNRTRLWL
Glyma06g11010.1        (518) KPI-PMKHAGM------------P-------PKPTKLYRGVRQRHWGKWVAEIRLPKNRTRLWL
Glyma13g01930.1        (510) KPV-PMKHVGG------------P-------AKPTKLYRGVRQRHWGKWVAEIRLPKNRTRLWL
Glyma14g34590.1        (514) KPV-PMKHVGG------------P-------PKPTKLYRGVRQRHWGKWVAEIRLPKNRTRLWL
Solyc04g054910.2.1     (498) SLV-PMKQTGA------------TSS-----QKATKLYRGVRQRHWGKWVAEIRLPKNRTRLWL
GSVIVT01002262001      (504) KAI-PMKQVGT------------P-------PKPAKLYRGVRQRHWGKWVAEIRLPKNRTRLWL
POPTR_0005s07900.1     (500) KPV-PMKQSAA------------SP------QKPTKLYRGVRQRHWGKWVAEIRLPKNRTRLWL
POPTR_0007s05690.1     (502) KPV-PMKQQSA------------SPP-----PKPTKLYRGVRQRHWGKWVAEIRLPKNRTRLWL
AT1G22190.1            (490) KPV-SMKQTGT------------SA------AKPTKLYRGVRQRHWGKWVAEIRLPKNRTRLWL
AT1G78080.1            (492) KPL-LMKQSGVAGSCFAYGSGVP--------SKPTKLYRGVRQRHWGKWVAEIRLPKNRTRLWL
AT2G22200.1            (494) NRI-RMKNLTP------------ST------SKTKNLYRGVRQRHWGKWVAEIRLPKNRTRLWL
AT5G65130.1            (496) KPT-SMKKIDV------------A-------TKPVKLYRGVRQRQWGKWVAEIRLPXNRTRLWL
Consensus              (579)                                       LYRGVRQRXWGKWVAEIRLPXNRTRLWL
```

FIG. 11D

```
LOC_Os03g09170.1       (544)  GTFDTAEEAALAYDSAAFRLRGESARLNFPELRR-GGAHLGP------PLHAAVDAKLHA
GRMZM2G113060_T01      (546)  GTFDTAEEAALAYDGAAFRLRGDSARLNFPELRR-GGQHLGP------PLHAAVDAKLHA
Solyc12g056980.1.1     (526)  GTFDTAEEAALAYDKAAYKLRGEFARLNFPHLRH-NGSLIGSEFGEYKPLHSSVNAKLQA
Bradi4g29010.1         (528)  GTFDTAEEAALAYDQAAYRLRGDAARLNFPDNAASRG-----------PLDASVDAKLQT
LOC_Os08g31580.1       (530)  GTFDTAEEAALTYDQAAYRLRGDAARLNFPDNAASRG-----------PLDAAVDAKLQA
GRMZM5G852704_T01      (540)  GTFDSAEDAALAYDKAAFRLRGDAARLNFPSLRR-GGAHLAG------PLDASVDAKLTA
Si008385m              (542)  GTFGSAEDAALAYDKAAFRLRGDAARLNFPSLRR-GGSHLAG------PLDASVDAKLTA
Bradi3g58980.1         (538)  GTFDAAEDAALAYDKAAFRLRGDQARLNFPALRR-GGAHLAG------PLHASVDAKLTA
LOC_Os02g51670.1       (536)  GTFDTAEDAALAYDKAAFRLRGDLARLNFPTLRR-GGAHLAG------PLHASVDAKLTA
GRMZM2G029323_T01      (532)  GTFDTAEGAAALAYDEAAFRLRGDTARLNFPSLRRGGGARLAG-----PLHASVDAKLTA
Si017760m              (534)  GTFDTAEDAALAYDKAAFRLRGDMARLNFPALRR-GGAHLAG------PLHASVDAKLTA
Glyma18g02170.1        (512)  GTFDTAEEAALAYDNAAFKLRGENARLNFPHLRH-HGARAYGEFGNYKPLPSAVDAKLQA
POPTR_0002s09480.1     (520)  GTFDTAEEAALAYDRAAYKLRGDFARLNFPNLLH-QGSYI----GEYKPLHSSVDAKLQA
POPTR_0005s16690.1     (522)  GTFDTAEEAALAYDKAAYKLRGDFARLNFPNLRH-QGSHI----GEYKPLHSSVDAKLQA
Glyma05g31370.1        (506)  GTFDTAEEAALAYDKAAFKLRGEFARLNFPHLRH-HGAFVFGEFGDYRPLPSSVDSKLQA
Glyma08g14600.1        (508)  GTFDTAEEAALAYDNAAFKLRGEFARLNFPHLRH-HGAFVFGEFGDYKPLPSSVDSKLQA
GSVIVT01009007001      (524)  GTFDTAEEAALAYDKAAYKLRGDFARLNFPNLRH-QGSHIGGEFGDYKPLHSSVDAKLQA
Glyma04g11290.1        (516)  GTFDTAEEAALAYDKAAYKLRGDFARLNFPNLRH-QGSSVGGDFGEYKPLHSAVDAKLQA
Glyma06g11010.1        (518)  GTFDTAEEAALAYDKAAYKLRGDFARLNFPNLRH-QGSSVGGDFGEYKPLHSAVDAKLQA
Glyma13g01930.1        (510)  GTFDTAEEAALAYRLRGDLARLNFPNLK----GSCPG---EEYKPMQAAVDAKLDA
Glyma14g34590.1        (514)  GTFDTAEEAALAYDKAAYKLRGEFARLNFPSLK----GSCPG---EEYKPVHSAVDAKLDA
Solyc04g054910.2.1     (498)  GTFDTAEEAALAYDKAAYKLRGEFARLNFPHLRH-Q----LNNEFSDFKPLHSSVDAKLQA
GSVIVT01002262001      (504)  GTFDTAEEAALAYDKAAYKLRGEFARLNFPHLRH-QGSLVAGEFGDYKPLHSSVDAKLQA
POPTR_0005s07900.1     (500)  GTYDTAEEAALAYDNAAYKLRGEYARLNFPHLRH-QGAHVSGEFGDYKPLHSSVDAKLQA
POPTR_0007s05690.1     (502)  GTFDTAEEAALAYDKAAYKLRGEFARLNFPHLRH-QGAHVSGEFGDYKPLHSSVDAKLQA
AT1G22190.1            (490)  GTFDTAEEAALAYDKAAYKLRGDFARLNFPDLRH-N------DEYQPLQSSVDAKLEA
AT1G78080.1            (492)  GTFDTAEEAALAYDKAAYKLRGDFARLNFPNLRH-NGSHIGGDFGEYKPLHSSVDAKLEA
AT2G22200.1            (494)  GTFETAEKAALAYDQAAFQLRGDIAKLNFPNLIH--------EDMNPLPSSVDTKLQA
AT5G65130.1            (496)  GTFETAQEAALAYDQAAHKIRGDNARLNFPDIVR-QGHYKQ-------ILSPSINAKIES
Consensus             (579,580) GTXxxAXxxAAXXYDxAAxxxRGXxAXLNFP      XxxXXXXXxxx
```

FIG. 11E

| Sequence | Start | Alignment |
|---|---|---|
| LOC_Os03g09170.1 | (544) | ICHGMDLPQPQPQTQSNATTTMSTTATNTPSPFFSSESPVVKSEPVC------------------- |
| GRMZM2G113060_T01 | (546) | ICSGADVGAPLPQGQSQSHATAAATTATPSP----FSSVSPHVKSEPGC------------------ |
| Solyc12g056980.1.1 | (526) | ICQDLA-QGKSIDTKKKRKVSSKAMMVEVEE------KEYKKSKTTAEA------------------ |
| Bradi4g29010.1 | (528) | LCQNIT--ASKNAKKSKSSSASAATSSTPTS------NCSSPSSDEASS------------------ |
| LOC_Os08g31580.1 | (530) | ICDTIA-ASKNASSRSRGGAGRAMPINAPLV------AAASSSGSDHS------------------ |
| GRMZM5G852704_T01 | (540) | ICQGIT-----AEPTSKAAAAAPSDSPKAS------ASTTTEGDESV------------------ |
| Si008385m | (542) | ICQGLA------AAPDSKSAAAAPESPKAS------ASTTTEGDESV------------------ |
| Bradi3g58980.1 | (538) | ICQSLQ------NPAAAEPESPKCS------AASASTEGDNDS------------------ |
| LOC_Os02g51670.1 | (536) | ICQSLA-TSSSKNTPAESAASAAEPESP------KCSASTEGEDSV------------------ |
| GRMZM2G029323_T01 | (532) | ICQSLA---GSKNSSSSDESAASLPDSP------KCSASTEGDEDS------------------ |
| Si017760m | (534) | ICQSLA---GSKSGSPDAESSAASPPDSP------KCSASTEGEEES------------------ |
| Glyma18g02170.1 | (512) | ICQSLG--TNSQKLKTQNPIVLDTHKAETET------SEFQDFNKVENY------------------ |
| POPTR_0002s09480.1 | (520) | ICKSLENSSQQKQGGKAKRQSNSTKKKA------NLAVVTQEEEQV------------------ |
| POPTR_0005s16690.1 | (522) | ICESLENSSQQKRGKRGKVEKRSNSTKKET------SLVVGTQEEEPV------------------ |
| Glyma05g31370.1 | (506) | ICESLA-KQEEKPCCSVEDVKPVIHAAELAE------VESDVAKLNAEY-----VYPE |
| Glyma08g14600.1 | (508) | ICESLA-KQEEKPCCSVEDVKPVIHAAELAE------VESDVAKSNAEY------------------ |
| GSVIVT01009007001 | (524) | ICQSLA--ETQKQGKPTQGKKSRSRAVAP------SASQPSDGS------------------ |
| Glyma04g11290.1 | (516) | ICEGLA--ELQKQGKTEKPPRKTRS------KLASPPENDNNN------------------ |
| Glyma06g11010.1 | (518) | ICEGLA--ELQKQGKTEKPPRKSRS------KLAEKVVSDKEN------------------ |
| Glyma13g01930.1 | (510) | ICANLA--EMQKQGKNEKGARSGKKS------KQGPNLEAKPEP------------------ |
| Glyma14g34590.1 | (514) | ICANLA--EMQKQGKTEKGARSA------KKSKQGPNQEAK------------------ |
| Solyc04g054910.2.1 | (498) | ICQSLA-NPKSDDSCSKSNSKPRKSKTAAVSVDS--NSAQESSSKSEITTDDSLKEEFSY |
| GSVIVT01002262001 | (504) | ICQNLA--ISQKQGNSGKPGLVAD------AKIESSTHQAEM------------------ |
| POPTR_0005s07900.1 | (500) | ICQSLGLQKQGKTREPSSVANSKKTATAPLQAKIEDDCSLRGELKTEY----ENFG |
| POPTR_0007s05690.1 | (502) | ICQSLGLQKQGETGEPCSVSDSKKTVSAPLQVKIEDDCSLQGELKREF----ENLG |
| AT1G22190.1 | (490) | ICQNLA--ETTQKQVRSTKKSSSRKRSS------TVAVKLPEEDYS------------------ |
| AT1G78080.1 | (492) | ICKSMA-ETQKQKDKSTKSSSKKREKKVSSP------DLSEKVKAEENS------------------ |
| AT2G22200.1 | (494) | ICKSLR-KTEEICSVSDQTKEYSVYSVSDKTELFLPKAELFLPKREHL-------ETNE |
| AT5G65130.1 | (496) | ICNSSDLPLPQIEKQNKTEEVL------------SGFSKPEKEPEF------------------ |
| Consensus | (580) | XC |

FIG. 11F

```
LOC_Os03g09170.1      (544) ------SASESSSSADGDVSST-GSSDVVPEMQLLDFSE--A---PWD-ESESFLLHKYPS
GRMZM2G113060_T01     (546) ------SVSESSFSADGDVSST-GSSDVVPEMQLLDFSE--A---PWD-ESDSFHLRKYPS
Solyc12g056980.1.1    (526) ------GSESDGSGSGSGSGSGSGSSPISEYTFDS------------IWDMCSENYVLHKDPS
Bradi4g29010.1        (528) ---------SLESAESSPSPATNAAEVPEMQQLDFSE--A---PWD-EAAGFALTKYPS
LOC_Os08g31580.1      (530) ------GGGDDGGSETSSSSAAASPLAEMEQLDFSE--V---PWD-EAEGFALTKYPS
GRMZM5G852704_T01     (540) ------HSAGSPPPSLPTFPQQQQVTPPLPEMASLDFTE--A---PWD-ESAALHLNSYPS
Si008385m             (542) ------HSAGSPPPLPAFQQQQ-QQVAPVPEMASLDFTE--A---PWD-ESAALHLNKYPS
Bradi3g58980.1        (538) ------------ASASAAGSPGAPVPGMEKLDFTE--A---PWD-ESETFHLRKYPS
LOC_Os02g51670.1      (536) ------------SAGSPPPPTPLSPPVPEMEKLDFTE--A---PWD-ESETFHLRKYPS
GRMZM2G029323_T01     (532) ------------ASAGSPPSP-TQAPPVPEMAKLDFTE--A---PWD-ETEAFHLRKYPS
Si017760m             (534) ------------VSAGSPPSP-PLAPPVPEMAKLDFTE--A---PWD-ETEAFHLRKYPS
Glyma18g02170.1       (512) ------QTSSSSAFSDEYSSSSSSSPESDITLLDFSDCE---TMD--NLGLDLEKYPS
POPTR_0002s09480.1    (520) ------VVKAETESPALTESTASGGSSLSDSPLSDLTFPDFEE---A---PLDFESGNFMLQKYPS
POPTR_0005s16690.1    (522) ------VKSETPSPVLTESDGS-GGSSPLSDLTFPDIEE---A---PLEFDSGNFMLQKYPS
Glyma05g31370.1       (506) FED---FKVENENPMLSSSVSG-ESSSPESGVTFLDFSDFSDSNNQWD-EMENFGLEKFPS
POPTR_0008g14600.1    (508) ---VYPEFEDFKVEHENPMFSGESSSPESSVTFLDFSDFSDSNNQWD-EMENFGLEKFPS
GSVIVT01009007001    (524) ------------GGSSPLSDLTFPDDCEEAPFYGAWE-----NFNLQKYPS
Glyma04g11290.1       (516) ------DNNSCKVEAASSSSEGSSPLSVLTFADVSE--P---QWEGDSDNFNLQKYPS
Glyma06g11010.1       (518) ------NNSCKVEAAASWSSEGSSPLSDLTFADVSE--A---QWEGDSDNYNLQKYPS
Glyma13g01930.1       (510) ------EASGSGAAAALSPESEGSADSSALSDLTF-DVTE--P---QWEDASAHFNLQKFPS
Glyma14g34590.1       (514) ------PEPQASAESEGSADSSPLSDLTF-DVTE--P---QWE---HFNLQKFPS
Solyc04g054910.2.1    (498) PENGTIKIEASSSSSPPTPSEESSSSSESDITFLDFAE--P---SFD-ESENFFLPKYPS
GSVIVT01002262001    (504) ------ISSSSSSPSPSDESSA-GSSSPESDISFLDFSG--SL--QWN-DSECLIIEKFPS
POPTR_0005s07900.1    (500) ---VEDYKVEIPSPSPASSDESLA-GSSSPESEISFLDFSG--SL--QWD-EFENFGLEKYPS
POPTR_0007s05690.1    (502) ---VEEFKVEIPSPSPALSDESLA-GSSSPESEISFF-FSD--SL--QWD-EFENFGLEKYPS
AT1G22190.1           (490) ----------------SAGSPLLTESYGSGGSSSLSELTFGDTEE---EIQPPWN----ENALEKYPS
AT1G78080.1           (492) ----------------VSIGGSPPVTEFEESTAGSSPLSDLTFADPEE---PP--QWN--ETFSLEKYPS
AT2G22200.1           (494) ---------------LSNESPRSDETSLLDESQAEYSSSDKTFLDFSD--T----EFE-EIGSFGLRKFPS
AT5G65130.1           (496) ---------------GEIYGCGYSGSSSPESDITLLDFSSDCV---KED-ESFLMGLHKYPS
Consensus             (581)                                                        LxxxPS
```

FIG. 11G

| | | |
|---|---|---|
| LOC_Os03g09170.1 | (544) | LEI-DWDAILS------ |
| GRMZM2G113060_T01 | (546) | LEI-DWDSILIS------ |
| Solyc12g056980.1.1 | (526) | QEIFNWASLL------- |
| Bradi4g29010.1 | (528) | YEI-DWDSLLATN---- |
| LOC_Os08g31580.1 | (530) | YEI-DWDSLLNNNN--- |
| GRMZM5G852704_T01 | (540) | WDI-DWDSILS------ |
| Si008385m | (542) | WEI-DWDSILS------ |
| Bradi3g58980.1 | (538) | VEI-DWDSILS------ |
| LOC_Os02g51670.1 | (536) | WEI-DWDSILS------ |
| GRMZM2G029323_T01 | (532) | WEI-DWDSILS------ |
| Si017760m | (534) | WEI-DWDSILS------ |
| Glyma18g02170.1 | (512) | VEI-DWAALSDS----- |
| POPTR_0002s09480.1 | (520) | YEI-DWASILS------ |
| POPTR_0005s16690.1 | (522) | YEI-DWASILS------ |
| Glyma05g31370.1 | (506) | VEI-DWAAI-------- |
| Glyma08g14600.1 | (508) | VEI-DWEAI-------- |
| GSVIVT01009007001 | (524) | NEI-DWAAISSQWP--- |
| Glyma04g11290.1 | (516) | YEI-DWDSL-------- |
| Glyma06g11010.1 | (518) | YEI-DWDSL-------- |
| Glyma13g01930.1 | (510) | YEI-DWDSL-------- |
| Glyma14g34590.1 | (514) | YEI-DWDSL-------- |
| Solyc04g054910.2.1 | (498) | VEI-DWAAL-------- |
| GSVIVT01002262001 | (504) | VEI-DWASI-------- |
| POPTR_0005s07900.1 | (500) | VEI-DWSSI-------- |
| POPTR_0007s05690.1 | (502) | VEI-DWSSI-------- |
| AT1G22190.1 | (490) | YEI-DWDSILQCSSLVN |
| AT1G78080.1 | (492) | YEI-DWDSILA------ |
| AT2G22200.1 | (494) | VEI-DWDAISKLANS-- |
| AT5G65130.1 | (496) | LEI-DWDAIEKLF---- |
| Consensus | (581) | xXIxXWxxXX |

FIG. 11H

| Sequence | Start | Alignment |
|---|---|---|
| Solyc04g078690.2.1 | (655) | ------------------------------------------MADPYRTNPHASS-- |
| GRMZM2G017349_T01 | (645) | -------------------------------------MNEQGLGGLGGGRGAV |
| Bradi1g48400.1 | (627) | ----------------------------------------------MEDFEGG |
| LOC_Os06g06900.1 | (643) | -----------------------------------------------MDEQRG- |
| AT5G67110.1 | (665) | ------------------------------------------MGDSDVGDRLPP- |
| GSVIVT01009467001 | (639) | ------------------------------------------MADLYGTNVSSSATA |
| POPTR_0014s02590. | (631) | -----------------------------------------------MEDLYGAAA- |
| clementine0.9_017382m | (649) | -----------------------------------------------MADLYGTTPPTA- |
| clementine0.9_017468m | (651) | -----------------------------------------------MADLYGTTPPTA- |
| Solyc02g093280.2.1 | (633) | --------------------------------MANNNVYYHNANFSLTD |
| AT4G36930.1 | (625) | ------------MISQREEREEKKQRVMGDKKLISSSSSVYDTRINHHLHH |
| POPTR_0005s18280.1 | (659) | -------------------------------------MGDVYNNETNNINNT |
| LOC_Os02g56140.1 | (653) | -----------------------------------------------MMDGRG- |
| clementine0.9_029807m | (641) | -------------MEQDHVYQYNNNVNIYSTASSSSVHN |
| GRMZM2G030744_T02 | (661) | --------------------------------------------------- |
| GRMZM2G030744_T03 | (663) | --------------------------------------------------- |
| GSVIVT01022111001 | (637) | ------------------------------------------MADQYTKPCSSSPVP |
| Glyma01g39450.1 | (629) | ----------------------------------------------MYHFDKN- |
| Glyma11g05810.1 | (647) | ---------------------------------------MGDMYHFDKN---- |
| AT2G20180.2 | (689) | MHHFVPDFDTDDDYVNNHNSSLNHLPRKSITTMGEDDLMELLWQNGQVVVQRLHTKK |
| Glyma03g32740.1 | (691) | -----------------------------MELLWHNGQVVVQSQNQRSLR |
| Glyma10g04890.1 | (693) | -------------MDDDDEEYPIPVSKKPSTQNDEIMELLWQNGQVVMQNQNQRPFR |
| Glyma13g19250.1 | (695) | -----------------------------MELLWQNGQVVMQSQNQRPFR |
| LOC_Os03g43810.1 | (725) | -------------MNQFVPDWSNMGDASRTLGEDDNLIELLWCNGHVVMQSQNHHRKL |
| LOC_Os03g56950.7 | (723) | -------------MDGNARSAANQTKQIVTDNELVELLWHNGGVVAQPQAAQARV |
| LOC_Os03g56950.3 | (717) | --------------------MAICSTDNELVELLWHNGGVVAQPQAAQARV |
| LOC_Os03g56950.4 | (719) | --------------------MAICSTDNELVELLWHNGGVVAQPQAAQARV |
| LOC_Os03g56950.1 | (715) | -------------MDGNARSAANQTKQIVTDNELVELLWHNGGVVAQPQAAQARV |
| LOC_Os03g56950.2 | (721) | -------------MDGNARSAANQTKQIVTDNELVELLWHNGGVVAQPQAAQARV |

FIG. 14A

| | | |
|---|---|---|
| Solyc04g078690.2.1 | (655) | ----------------------------SLESEDMSSFFLNFLQGTPA-- |
| GRMZM2G017349_T01 | (645) | Q---------------------------GHGREAMALLQHQQLQQQRR-- |
| Bradi1g48400.1 | (627) | ----------------------------RGAVRELVLMQQERRRREE--- |
| LOC_Os06g06900.1 | (643) | ----------------------------RGGFDELVLLHQQQEQRRRR-- |
| AT5G67110.1 | (665) | ----------------------------PSSSDELSSFLRQILSRTPT-- |
| GSVIVT01009467001 | (639) | L---------------------------ALESEDISAFLHHFLHNQSS-- |
| POPTR_0014s02590.1 | (631) | ----------------------------ATEPEEISTFLHQLLHHNSS-- |
| clementine0.9_017382m | (649) | ----------------------------GHEPEEISSFLNQFIHNSSS-- |
| clementine0.9_017468m | (651) | ----------------------------GHEPEEISSFLNQFIHNSSS-- |
| Solyc02g093280.2.1 | (633) | P---------------------------DPEPDDISVFLRHILLPSSS-- |
| AT4G36930.1 | (625) | ----------------------------PSSSDEISQFLRHIFDRSSPLP |
| POPTR_0005s18280.1 | (659) | CSASS-----------------------SSRHYHRSSDDISLFLHQILPRSPS-- |
| LOC_Os02g56140.1 | (653) | ----------------------------SQEEEHLDLIMRHH-------- |
| clementine0.9_029807m | (641) | T---------------------------HVPPSSSDDISMFLHQILYRSSS-- |
| GRMZM2G030744_T02 | (661) | ----------------------------MDAQQQLDLVMRHQSMATV--- |
| GRMZM2G030744_T03 | (663) | ----------------------------MDAQQQLDLVMRHQSMATV--- |
| GSVIVT01022111001 | (637) | P---------------------------SSASEPDEISLFLHQILFRSSS-- |
| Glyma01g39450.1 | (629) | ----------------------------LSSQDEISLFLRQILLRSSP-- |
| Glyma11g05810.1 | (647) | ----------------------------LSSQDEISLFLRQILLRSSS-- |
| AT2G20180.2 | (689) | PSSSPPKL------LPSMDPQQQPS----SDQNLFIQEDEMTSWLHYPLRDD---- |
| Glyma03g32740.1 | (691) | K--LPPVTNSHDASPAGPSMTREIRPL-VENF--NQHLFMHEGEMASWLHYPIDDDEPAF |
| Glyma10g04890.1 | (693) | K--QPPTTD-GD---GPIPAREIRSSEAENY-NSQHLFMQEDEMASWLHYPIHEDPPPF |
| Glyma13g19250.1 | (695) | KPPQPPEANGGD----GAISAREIRSSEAENYNNSQHLFMQEDEMAAWLHYPIHEDPPPF |
| LOC_Os03g43810.1 | (725) | PPRPPE---------KAAAAAVQEDEAGLWFPFALADSLEKD |
| LOC_Os03g56950.7 | (723) | VSSSGRGQ------SASVLTGDDTETAAWFPDTLDDALEKD |
| LOC_Os03g56950.3 | (717) | VSSSGRGQ------SASVLTGDDTETAAWFPDTLDDALEKD |
| LOC_Os03g56950.4 | (719) | VSSSGRGQ------SASVLTGDDTETAAWFPDTLDDALEKD |
| LOC_Os03g56950.1 | (715) | VSSSGRGQ------SASVLTGDDTETAAWFPDTLDDALEKD |
| LOC_Os03g56950.2 | (721) | VSSSGRGQ------SASVLTGDDTETAAWFPDTLDDALEKD |

FIG. 14B

```
Solyc04g078690.2.1    (655) ------------------------------------------------APVAESSSSL--
GRMZM2G017349_T01     (645) ------------------------------------------------QLEEEDEVRRQM-
Bradi1g48400.1        (627) -------------------------------------------------EEDELRRQM-
LOC_Os06g06900.1      (643) ------------------------------------------------EQQQEEEEEEV-
AT5G67110.1           (665) ---------------------------AQP------------------SSPPKSTNVSSAETF-
GSVIVT01009467001     (639) ---------SSTTTSTIKAKHAHSFSPALLHP-----------------ETASAAEVLSPQKDRRR-
POPTR_0014s02590.1    (631) ------------------SPSKFMHHALSTP------------------VENGVELLDRHRF-
clementine0.9_017382m (649) -----------------------------------------------SSSSCFFAQPEDRHPF-
clementine0.9_017468m (651) -----------------------------------------------SSSSCFFAQPEDRHPF-
Solyc02g093280.2.1    (633) -----SSSSSSNFMALKSNEMQYSSSLP---------------------HLMPNNNQQGNLSSM-
AT4G36930.1           (625) SYYSPATTTTASLIGVHGSGDPHADNS----------------------RSLVSHHPPSDSVLM-
POPTR_0005s18280.1    (659) ----------STSSSSFIGPQTLQP------------------------FSVPAPFDDPL-
LOC_Os02g56140.1      (653) ---------------------------------------------------------------
clementine0.9_029807m (641) -------------SSSTTITATTSSP----------------------NVTHVVPHPVEISAHRL-
GRMZM2G030744_T02     (661) ---------------------------------------------------------------
GRMZM2G030744_T03     (663) ---------------------------------------------------------------
GSVIVT01022111001     (637) --------------SSSTTSLHNAKLMP---------------------SEFLSENPLRQCRSPL-
Glyma01g39450.1       (629) ----------PSSSSSSRPMPTVSCTSNVAHQ-----------------NVNAHPSFTASQL-
Glyma11g05810.1       (647) ----------PSHSMPAGSCTSNAAQQ----------------------NVNAHHPSFTASQL-
AT2G20180.2           (689) ----DFCSDLLFSAAPTATATATVSQVTA--------------------ARPPVSSTNESRPPV-
Glyma03g32740.1       (691) MQTLGHTSQLTELRPMSANPRPPIPPPR------RPEQRTPNFAYFSRHNTRAAEPSV-
Glyma10g04890.1       (693) DHHDFCADILYPPPNATASQNQSSASVQ----------------------SSPTVATAEHV-
Glyma13g19250.1       (695) DHHDFGADIFYPPPNATASQNRGSAAVQSSFRTTELWHPAPRPPIPPRRPEHAPSRI-
LOC_Os03g43810.1      (725) IFSDLFYEAPVAATAEAAPAGPGAGADGEGKTCKGDAAMAEEERGGPGAASEAPRELMPP
LOC_Os03g56950.7      (723) LYTQLWRSVTGDAFPAAAAAGPSSHHAP---------------------PPDLPPPAARPPM-
LOC_Os03g56950.3      (717) LYTQLWRSVTGDAFPAAAAAGPSSHHAP---------------------PPDLPPPAARPPM-
LOC_Os03g56950.4      (719) LYTQLWRSVTGDAFPAAAAAGPSSHHAP---------------------PPDLPPPAARPPM-
LOC_Os03g56950.1      (715) LYTQLWRSVTGDAFPAAAAAGPSSHHAP---------------------PPDLPPPAARPPM-
LOC_Os03g56950.2      (721) LYTQLWRSVTGDAFPAAAAAGPSSHHAP---------------------PPDLPPPAARPPM-
```

FIG. 14C

| Sequence | Position | Sequence |
|---|---|---|
| Solyc04g078690.2.1 | (655) | ---------------------------------------------------------------- |
| GRMZM2G017349_T01 | (645) | ---------------------------------------------------------------- |
| Bradi1g48400.1 | (627) | ---------------------------------------------------------------- |
| LOC_Os06g06900.1 | (643) | -----------------------------------------------------------FGPV- |
| AT5G67110.1 | (665) | -----------------------------------------------------------RRQM- |
| GSVIVT01009467001 | (639) | -----------------------------------------------------------FPSV- |
| POPTR_0014s02590.1 | (631) | ------------------------------------------FSRSAILSDSDCRVRSGLSTAGSSAV |
| clementine0.9_017382m | (649) | -----------------------------------------------------SETE------CGAGVNFSDP |
| clementine0.9_017468m | (651) | ---------------------------------------------------------------- |
| Solyc02g093280.2.1 | (633) | -----------------------------------------------------------MNSS------ACGI |
| AT4G36930.1 | (625) | -----------------------------------------------------------SKRV------GDFSEVL |
| POPTR_0005s18280.1 | (659) | -----------------------------------------------------------RSGV- |
| LOC_Os02g56140.1 | (653) | ---------------------------------------------------------------- |
| clementine0.9_029807m | (641) | -----------------------------------------------------------SKSS------GISAVDL |
| GRMZM2G030744_T02 | (661) | ---------------------------------------------------------------- |
| GRMZM2G030744_T03 | (663) | ---------------------------------------------------------------- |
| GSVIVT01022111001 | (637) | ---------------------------------------------------------------- |
| Glyma01g39450.1 | (629) | -----------------------------------------------------------QDGKIL- |
| Glyma11g05810.1 | (647) | -----------------------------------------------------------QDGKIL- |
| AT2G20180.2 | (689) | ----------------------------------------RNFMNFSRLRGDFNNGRGGESGPLLS |
| Glyma03g32740.1 | (691) | ----------------------------------------KAAARESTVVDSCDTEAAASRVSETV |
| Glyma10g04890.1 | (693) | -----------------------------------------------------------ETGR- |
| Glyma13g19250.1 | (695) | -----------------------------------------------------------HNFAHFTKHGNASSSSKAAAAQPTV |
| LOC_Os03g43810.1 | (725) | PKSTNASCSRQQTMSLADGGDNAGDLSELVRARRSSGGAARRKAEAGGGGGASSSMLSA |
| LOC_Os03g56950.7 | (723) | -----------------------------------------RSGIGSSWTGDICSAFCGSNHIPETA |
| LOC_Os03g56950.3 | (717) | -----------------------------------------RSGIGSSWTGDICSAFCGSNHIPETA |
| LOC_Os03g56950.4 | (719) | -----------------------------------------RSGIGSSWTGDICSAFCGSNHIPETA |
| LOC_Os03g56950.1 | (715) | -----------------------------------------RSGIGSSWTGDICSAFCGSNHIPETA |
| LOC_Os03g56950.2 | (721) | -----------------------------------------RSGIGSSWTGDICSAFCGSNHIPETA |

FIG. 14D

| | | |
|---|---|---|
| Solyc04g078690.2.1 | (655) | ------------------NFSDPGRFYAAEFKEGVENVFASAGLGECDGMNS--- |
| GRMZM2G017349_T01 | (645) | --------------------FGGVAAFPA------------ALGHGQQVDYGEDAGGLG--- |
| Bradi1g48400.1 | (627) | ---------VGGAAAFHSASALAQHHHQQQQQQAAAADCGELGGGF--- |
| LOC_Os06g06900.1 | (643) | FGAV-------------------VGGLAAFPA------------AAAALGQQQVDCGGELGGF--- |
| AT5G67110.1 | (665) | ------------------------------------SGGAVSSVGYGV |
| GSVIVT01009467001 | (639) | VESS---------------TGINFSDHGAYCPAGMKETAGNTFSSIAAVDSEAITV--- |
| POPTR_0014s02590.1 | (631) | DGYY--------------AKEGVG------------NAVVSKRGGVS--- |
| clementine0.9_017382m | (649) | --------------------GRSADPSVLDSSAGLNFSNLVVGA--- |
| clementine0.9_017468m | (651) | --------------------GRSADPSVLDSSAGLNFSNLVVGA--- |
| Solyc02g093280.2.1 | (633) | FSSS--------------YGVCNG-------------ATTVSSSSVGTID--- |
| AT4G36930.1 | (625) | IGGG---------------SGSAAACFGFSGGGNNNNVQGNSSGTRVSSSSVGASG--- |
| POPTR_0005s18280.1 | (659) | ----------------------------------ILGVDSSGGGGALWSGN--- |
| LOC_Os02g56140.1 | (653) | ---------------------------------ASMGLDR--- |
| clementine0.9_029807m | (641) | VNTS---------------VGVGGSLSG------------NVMVSGANVSSSSVGLSE--- |
| GRMZM2G030744_T02 | (661) | ------------------------------------ |
| GRMZM2G030744_T03 | (663) | ------------------------------------ |
| GSVIVT01022111001 | (637) | -------------ISSSDRLVRDGMNSSTGVYFPVSAGTASSSAGGFD--- |
| Glyma01g39450.1 | (629) | ---------ALDSTASFASGSAACSPFKGQGASAANVSSSSAGVSE--- |
| Glyma11g05810.1 | (647) | ---------AVDSTASFVSGSAACSSFKGHGASAANVSSSSAGVSE--- |
| AT2G20180.2 | (689) | KAVV-------RESTQVSPSATPSAAASESGLTRRTDGTDSSAVAGGGAYN |
| Glyma03g32740.1 | (691) | RSAAEGGA----GVAAPSTSAGGGRSTMMYDLTMTSSPGGSSCDEPVQ--- |
| Glyma10g04890.1 | (693) | ASVS--------AAAGKTPASDGGRETATCDVTVTSSPGGSSGSAEPVQ--- |
| Glyma13g19250.1 | (695) | VDSCETPVATAEHAETGRARAAAGKTAVSDGGRETATCDVTVTSSPGDSSGSAEPVE--- |
| LOC_Os03g43810.1 | (725) | IGSSICGSNQVQVQQRTASEPGRRGAPPSAVGSANAIPCGGRDHGHGHEATTVASSS--- |
| Glyma03g56950.7 | (723) | AQRC-------RDAGAALPPERPRRSSTHDGAGTSSSGGSGSNFGASG--- |
| LOC_Os03g56950.3 | (717) | AQRC-------RDAGAALPPERPRRSSTHDGAGTSSSGGSGSNFGASG--- |
| LOC_Os03g56950.4 | (719) | AQRC-------RDAGAALPPERPRRSSTHDGAGTSSSGGSGSNFGASG--- |
| LOC_Os03g56950.1 | (715) | AQRC-------RDAGAALPPERPRRSSTHDGAGTSSSGGSGSNFGASG--- |
| LOC_Os03g56950.2 | (721) | AQRC-------RDAGAALPPERPRRSSTHDGAGTSSSGGSGSNFGASG--- |

FIG. 14E

| Sequence | Position | Alignment |
|---|---|---|
| Solyc04g078690.2.1 | (655) | ----------------------------------ANRREFLEDDKVDNFGFSSEECDG---LDMPSD--- |
| GRMZM2G017349_T01 | (645) | ---------------------------------------------DSDAGGSE-------PEPPPE--- |
| Bradi1g48400.1 | (627) | ----------------------------------------------YESEA--G-----GSSEPE---- |
| LOC_Os06g06900.1 | (643) | ----------------------------------------------CDSEA--G-----GSSEPEA--- |
| AT5G67110.1 | (665) | ------------------------------------------------SETGQ------DKYAFE---- |
| GSVIVT01009467001 | (639) | ---------------------------SRKRRMFSMENSVDDFGCDSEK--G-------PEASD----- |
| POPTR_0014s02590.1 | (631) | -------------------------------------V-EDDLGDFSCDSEK--G----VEVQAN---- |
| clementine0.9_017382m | (649) | ---------------------------------------------VDSDTNDSEK--G----PDALEV---- |
| clementine0.9_017468m | (651) | -----------------------------------------------VDSDTNDSEG--G----PDALEV---- |
| Solyc02g093280.2.1 | (633) | ---------------------------------------------YDPDEYECESED--G----TEDLGA---- |
| AT4G36930.1 | (625) | ----------------------------------------------NETDEYDCESEE--G----GEAVVD---- |
| POPTR_0005s18280.1 | (659) | --------------------------VRTRLIMSENETDHECDCESEE--G----LEALID---- |
| LOC_Os02g56140.1 | (653) | -------------------------------------------------CESEEEALG--G----SSESE----- |
| clementine0.9_029807m | (641) | ----------------------------------------NENTDEHDCQSEE--G----IQASVDE--- |
| GRMZM2G030744_T02 | (661) | -----------------------------------------------CESEDALG--G----SSESD----- |
| GRMZM2G030744_T03 | (663) | -----------------------------------------------CESEDALG--G----SSESD----- |
| GSVIVT01022111001 | (637) | ---------------------------------------------NDLDEYDCESEE--G----LEALVEE---- |
| Glyma01g39450.1 | (629) | ---------------------------------------------NENDDYDCESEE--G----VEALAEE---- |
| Glyma11g05810.1 | (647) | ---------------------------------------------NENDDYDCESEE--G----VEAPAEE---- |
| AT2G20180.2 | (689) | RKGKAVAMTAPAIEITGTSSSVVSKSEIEPEKTNVDDRKRKREATTDETESRSE----- |
| Glyma03g32740.1 | (691) | -----------------VAAAEEDRKRKRKGREAEE----WECQSELQIP |
| Glyma10g04890.1 | (693) | ---------------------------REPVVNRKRKGREQEE----SEYQSE---- |
| Glyma13g19250.1 | (695) | ---------------------------REPMADRKRKGREHEE----SEFQSE---- |
| LOC_Os03g43810.1 | (725) | -------GRSNCCFGTTTTTEPTSTSNRSSKRKRLDTTEDSESPSED |
| LOC_Os03g56950.7 | (723) | -----------------LPSESASAHKRKGRE---D---SDSRSED--- |
| LOC_Os03g56950.3 | (717) | -----------------LPSESASAHKRKGRE---D---SDSRSED--- |
| LOC_Os03g56950.4 | (719) | -----------------LPSESASAHKRKGRE---D---SDSRSED--- |
| LOC_Os03g56950.1 | (715) | -----------------LPSESASAHKRKGRE---D---SDSRSED--- |
| LOC_Os03g56950.2 | (721) | -----------------LPSESASAHKRKGRE---D---SDSRSED--- |

FIG. 14F

| | | |
|---|---|---|
| Solyc04g078690.2.1 | (655) | ------------------------------------------------PTHPRSS |
| GRMZM2G017349_T01 | (645) | -----------------------------------------RTRGGSGGGG |
| Bradi1g48400.1 | (627) | -----------------------------------------PHSSERPRGGSGS |
| LOC_Os06g06900.1 | (643) | -----------------------------------------AAGARPRGGSGS |
| AT5G67110.1 | (665) | -----------------------------------------HKRSGAKQRNSL |
| GSVIVT01009467001 | (639) | -----------------------------------------VPSNPAPSRSSS |
| POPTR_0014s02590.1 | (631) | -----------------------------------------TARP---RSSS |
| clementine0.9_017382m | (649) | -----------------------------------------PSNDTVRTKTSS |
| clementine0.9_017468m | (651) | -----------------------------------------PSNDTVRTKTSS |
| Solyc02g093280.2.1 | (633) | -----------------------------------------EASVQPPSRNTS |
| AT4G36930.1 | (625) | -----------------------------------------EAPSSKSGPSSRSSS |
| POPTR_0005s18280.1 | (659) | -----------------------------------------EMSVKPAPPRSS |
| LOC_Os02g56140.1 | (653) | -----------------------------------------QPTRPARPRG- |
| clementine0.9_029807m | (641) | -----------------------------------------VTAKPVRPRSSS |
| GRMZM2G030744_T02 | (661) | -----------------------------------------PARPARPRG- |
| GRMZM2G030744_T03 | (663) | -----------------------------------------PARPARPRG- |
| GSVIVT01022111001 | (637) | -----------------------------------------VATKAAPLRSSS |
| Glyma01g39450.1 | (629) | -----------------------------------------VPTKAASSRSSS |
| Glyma11g05810.1 | (647) | -----------------------------------------VPTKAASSRSSS |
| AT2G20180.2 | (689) | -----------------------------------------ETKQARVSTTST |
| Glyma03g32740.1 | (691) | CTLVYANVRWVSDVGLREHSPRCCIYFGAVALCSFGTVITFTVVAAHVQAKKQVCGSTST |
| Glyma10g04890.1 | (693) | -----------------------------------------VTKKQVRGSTST |
| Glyma13g19250.1 | (695) | -----------------------------------------DVDFESPEAKKQVHGSTST |
| LOC_Os03g43810.1 | (725) | -----------------------------------------AESESAALARKPPAKMTTA |
| LOC_Os03g56950.7 | (723) | -----------------------------------------AECEATEETKSSSRRYGSK |
| LOC_Os03g56950.3 | (717) | -----------------------------------------AECEATEETKSSSRRYGSK |
| LOC_Os03g56950.4 | (719) | -----------------------------------------AECEATEETKSSSRRYGSK |
| LOC_Os03g56950.1 | (715) | -----------------------------------------AECEATEETKSSSRRYGSK |
| LOC_Os03g56950.2 | (721) | -----------------------------------------AECEATEETKSSSRRYGSK |

FIG. 14G

```
Solyc04g078690.2.1      (655) KRSRSAEVHNLSEKRRRSRINEKLKALQNLIPNSNKTDKASMLDEAIEYLKQLQLQVQIL
GRMZM2G017349_T01       (645) KRSRAAEVHNLSEKRRRSKINEKMKALQSLIPNSNKTDKASMLDEAIEYLKQLQLQVQML
Bradi1g48400.1          (627) KRTRAAEVHNLSEKRRRSKINEKMKALQSLIPNSNKTDKASMLDEAIEYLKQLQLQVQML
LOC_Os06g06900.1        (643) KRSRAAEVHNLSEKRRRSKINEKMKALQSLIPNSNKTDKASMLDEAIEYLKQLQLQVQML
AT5G67110.1             (665) KRNIDAQFHNLSEKRRRSKINEKMKALQKLIPNSNKTDKASMLDEAIEYLKQLQLQVQTL
GSVIVT01009467001       (639) KRSRAAEVHNLSEKRRRSRINEKMKALQNLIPNSNKTDKASMLDEAIEYLKQLQLQVQML
POPTR_0014s02590.1      (631) KRSRAAEVHNLSEKRRRSRINEKLKALQNLIPNSNKTDKASMLDEAIEYLKQLQLQVQML
clementine0.9_017382m   (649) KRSRAAEVHNLSEKRRRSRINEKLKALQNLIPNSNKTDKASMLDEAIEYLKQLQLQVQML
clementine0.9_017468m   (651) KRSRAAEVHNLSEKRRRSRINEKMKALQNLIPNSNKTDKASMLDEAIEYLKQLQLQVQML
Solyc02g093280.2.1      (633) KRSRAAEVHNLSEKRRRSRINEKMKALQKLIPNSNKTDKASMLDEAIEYLKQLQLQVQML
AT4G36930.1             (625) KRCRAAEVHNLSEKRRRSRINEKMKALQSLIPNSNKTDKASMLDEAIEYLKLLQLQVQGL
POPTR_0005s18280.1      (659) KRTRAAEVHNLSEKRRRSRINEKMKALQNLIPNSSKTDKASMLDEAIEYLKHLQLQVQML
LOC_Os02g56140.1        (653) KRSRAAEVHNLSEKRRRSRINEKMKALQSLIPNSSKTDKASMDDAIEYLKHLQLQVQDVL
clementine0.9_029807m   (641) KRSRAAEVHNLSEKRRRSRINEKMKALQTLIPNSSKTDKASMDDAIEYLKHLQLQVQML
GRMZM2G030744_T02       (661) KRSRAAEVHNLSEKRRRSRINEKMKALQTLIPNSSKTDKASMDDAIEYLKHLQLQVQML
GRMZM2G030744_T03       (663) KRSRAAEVHNLSEKRRRSRINEKMKALQNLIPNSNKTDKASMLDEAIEYLKQLQLQVQML
GSVIVT01022111001       (637) KRSRAAEVHNLSEKRRRSRINEKMKALQNLIPNSNKTDKASMLDEAIEYLKQLQLQVQML
Glyma01g39450.1         (629) KRSRAAEVHNLSEKRRRGRINEKMKALQNLIPNSNKTDKASMLDEAIEYLKQLQLQVQML
Glyma11g05810.1         (647) KRSRAAEVHNLSEKRRRGRINEKMKALQNLIPNSNKTDKASMLDEAIEYMKSLQLQIQMM
AT2G20180.2             (689) KRSRAAEVHNLSERKRRRDRINERMKALQELIPRCNKSDKASMLDEAISYLKSLQLQVQMM
Glyma03g32740.1         (691) KRSHAAEVHNLSERRRRDRINEKMKALQELIPRCNKSDKASMLDEAIEYLKSLQLQVQMM
Glyma10g04890.1         (693) KRSRAAEVHNLSERRRRDRINEKMKALQELIPRCNKSDKASMLDEAIEYLKSLQLQVQMM
Glyma13g19250.1         (695) KRSRAAEVHNLSERRRRDRINEKMKALQELIPRCNKSDKASMLDEAIEYLKSLQLQVQMM
LOC_Os03g43810.1        (725) RRSRAAEVHNLSERRRRRDRINEKMRALQELIPHCNKTDKASMLDEAIEYLKSLQLQMM
LOC_Os03g56950.7        (723) RRTRAAEVHNLSERRRRRDRINEKMRALQELIPHCNKTDKASILDEAIEYLKSLQMQVQIM
LOC_Os03g56950.3        (717) RRTRAAEVHNLSERRRRRDRINEKMRALQELIPHCNKTDKASILDEAIEYLKSLQMQVQIM
LOC_Os03g56950.4        (719) RRTRAAEVHNLSERRRRRDRINEKMRALQELIPHCNKTDKASILDEAIEYLKSLQMQVQIM
LOC_Os03g56950.1        (715) RRTRAAEVHNLSERRRRRDRINEKMRALQELIPHCNKTDKASILDEAIEYLKSLQMQVQIM
LOC_Os03g56950.2        (721) RRTRAAEVHNLSERRRRRDRINEKMRALQxLIPHCNKTDKASILDEAIEYLKSLQMQVQIM
Consensus               (687) KRxxxAXxHNLSEKxRRxxINEKxxKALxxLIPNSxKTDKASXLDXAIEYLKxLXLXVQxx
```

FIG. 14H

```
Solyc04g078690.2.1    (655) TLRNGLSLYPGYVPG-SLQSVQLPS------------------------GNEFDG--RSFMLSANGGATLP
GRMZM2G017349_T01     (645) SMRNGVYLNPPYLSG-TIEPAQASQMF-------------AAVGGGN----ITASSSGAVMPP
Bradi1g48400.1        (627) SMRNGVYLNPSYLSG-ALEPMQASQMF-------------AALGVGG--RNVTAANPGGVVPP
LOC_Os06g06900.1      (643) SMRNGVYLNPSYLSG-ALEPAQASQMF-------------AALGGNN----VTVVHPGTVMPP
AT5G67110.1           (665) AVMNGLGLNPMRLPQ-------------------------------------------------
GSVIVT01009467001     (639) TMRNGLSLHPIYIPG-ALQPTQLPQTG-------------AGFAEGN---LLLSNSGTGTLP
POPTR_0014s02590.1    (631) TMRNGLSLHPMCLPG-ALQPMQLPLSG-------------MSFDEGI---GLLTTNLTGIFS
clementine0.9_017382m (649) TMRNGLSLHPMWLPG-VLPSMQLPQTG-------------MVFDEGN---GLLNTNGGTETFS
clementine0.9_017468m (651) TMRNGLSLHPMWLPG-VLPSMQLPQTG-------------MVFDEGN---GLLNTNGGTETFS
Solyc02g093280.2.1    (633) TMRNGLNMYPLGLPR-MLQQNQLSHQK-------------VGLCEGN---AFTNAKVAGNLQ
AT4G36930.1           (625) TMRNGINLHPLCLPGTTLHPLQLSQIR-------------------------------PP
POPTR_0005s18280.1    (659) SVR-------------------------------------------------------------
LOC_Os02g56140.1      (653) SMRNGLYLPPVNLSG-APEHLPIPQMS-------------AALDQNS---AKASDPSVVLQP
clementine0.9_029807m (641) TMRNGMSLHPMCLPG-ILPPIQLPHMR-------------MGFGVGN---GSLHMNSTGTLV
GRMZM2G030744_T02     (661) SMRNGLYLPPGNLSG-APETLAPLEMC-------------AALNQSG---AKASNSGVVVLP
GRMZM2G030744_T03     (663) SMRNGLYLPPGNLSG-APETLAPLEMC-------------AALNQSG---AKASNSGVVVLP
GSVIVT01022111001     (637) SMRNGLSLHPMCLPG-VLPPVQLSQMR-------------IGIGEEN---GSLHMDMTGTLP
Glyma01g39450.1       (629) SMRNGLSLHPMCFPD-GLQPLQLSQMX-------------------------------------
Glyma11g05810.1       (647) SMRNGLSLHPMCFPE-GLQPLQLSQMG-------------MELSERN---RFTSLNMSATLP
AT2G20180.2           (689) SMGCGMM--PMMYPG-MQQYMPHMAMG-------------MGMNQPI---PPPSFMP
Glyma03g32740.1       (691) SMGCGMV--PVMFPG-IQQYMPAMGMGVGMGMGME-MGMNRPV--MPFPNMLPGS-ALP
Glyma10g04890.1       (693) SMGCGMV--PMIFPG-IQQYMPPMGMGIGMGMGMEMGMGMNRSVMPFPNMLASS-TLP
Glyma13g19250.1       (695) SMGYGMV--PMMFPG-IQQYMPPMGMGIGMGMGMEMGMGMNRPV--MPFTNMLASS-TLP
LOC_Os03g43810.1      (725) WMGSGMA-PPVMFPG-VHQYLPRMG---------------VGMGAAA---------AAMPRMP
LOC_Os03g56950.7      (723) WMTTGMA--PMMFPG-AHQFMPPMA---------------VGMNSAC--MPAAQGLSHMSRLP
LOC_Os03g56950.3      (717) WMTTGMA--PMMFPG-AHQFMPPMA---------------VGMNSAC--MPAAQGLSHMSRLP
LOC_Os03g56950.4      (719) WMTTGMA--PMMFPG-AHQFMPPMA---------------VGMNSAC--MPAAQGLSHMSRLP
LOC_Os03g56950.1      (715) WMTTGMA--PMMFPG-AHQFMPPMA---------------VGMNSAC--MPAAQGLSHMSRLP
LOC_Os03g56950.2      (721) WMTTGMA--PMMFPG-AHQFMPPMA---------------VGMNSAC--MPAAQGLSHMSRLP
Consensus             (687) xx
```

FIG. 14I

```
Solyc04g078690.2.1    (655) VNREMPQTA------FEISNQNPSGKPTITSH-NTENAVALETTIQNHYGLLNHLASSK
GRMZM2G017349_T01     (645) VNQSSGLQVF--DPLNPPRDQPLSFVLPNVDKT-IQEAPFHLESS-QFHPRFRMPESSE
Bradi1g48400.1        (627) VNQNTGAHHSFDPMNSPPQNQQPPLVLPSCPNATIPEPSFHLGTS-QSHLRFQLPESSE
LOC_Os06g06900.1      (643) VNQSSGAHHLFDPLNSPPQNQPQSLIIPSVPSTAIPEPPFHLESS-QSHLRQFQLPGSSE
AT5G67110.1           (665) ---------------------VPPPTHTRINETLEQDLNLETLLAAPHSLEPAKTSQ
GSVIVT01009467001     (639) ANQEISMQT------TFDLTSQPIAIPTMTMNNSDTSFGFEHSDQPHYGPFNLTGSSK
POPTR_0014s02590.1    (631) ANEESSEQNSLNLPT-QCTISNQPITIPSGTNITSSETNFGFEPQIHVNHAPFNLSTSSK
clementine0.9_017382m (649) ANEESSVQTGFNLSS-QCTISNQPVALPSAANISTSETAFGLEPLIQAHYGPFTLPPSSK
clementine0.9_017468m (651) ANEESSVQTGFNLSS-QCTISNQPVALPSAANISTSETAFGLEPLIQAHYGPFTLPPSSK
Solyc02g093280.2.1    (633) VNQDASLNAIFNPT--ENCTETKVTPPITMSNINRSDSAFELESSMNIHLDPFQLSRSTS
AT4G36930.1           (625) EATNDPL--------LNHTNQFASTSNAPEMINTVASSYALEPSIRSHFGPFPLLISPV
POPTR_0005s18280.1    (659) ---------------------------------FLEIYRSSENDKFKIFLEFK
LOC_Os02g56140.1      (653) VNQTSGALLPF----ELASQHKPLFLPGVPNATALEPRFLVESS-RSNLQSLRFTEPAE
clementine0.9_029807m (641) SQETSTLNVFNLP--NQHISSNQLQLPSTSNIINSETEFGLDASIQANFGFQHGTASG
GRMZM2G030744_T02     (661) GNKIPVARLLLDPPN-HDQRHENPLVLQSVPSSSTAVEPRFLQQPAQPNLQSFQLAVPPE
GRMZM2G030744_T03     (663) GNKIPVARLLLDPPN-HDQRHENPLVLQSVPSSSTAVEPRFLQQPAQPNLQSFQLAVPPE
GSVIVT01022111001     (637) VNQETMEYRLA----NQGTSSSHPSVPNLTDIMNSETSFGLESSIQAHLGPFQLQTSSA
Glyma01g39450.1       (629) ---------------------------------
Glyma11g05810.1       (647) LHQDNNPLHYASNLPNKHNLPNQPS-VPYPPYIDNPETSFGLEPRIQTDMKPLQHKGGSS
AT2G20180.2           (689) FPNMLAAQRPL----PTQTHMAGSGPQYPVHASDPSRVFVPNQQYDPTSGQPQYPAGYT
Glyma03g32740.1       (691) AATAAAAAHLGP--------------------RMQAANQSDNNMVTSAGPPDPNQSRIP-NFT
Glyma10g04890.1       (693) AAT-ATAHLGPRFPMPPFHMPHVATPDSSRMQGANHPDNNMLNSLGTLDPDQSCIP-NFT
Glyma13g19250.1       (695) AAT-AAVHLGPRFPMPPFHMPHVAAPDSSRMQGANHPDNNMLNSLGTLDPDQSRIP-NFT
LOC_Os03g43810.1      (725) FMAAPQPVVPTPP---VNHLDLGVNHLQPPPTQGVGYYPLGAKAVQQQNPPLHVPNGSI
LOC_Os03g56950.7      (723) YMNHSM---------PNHIPLNSSPAMNPMNVANQMQNIQLREA----SNPFLHPDGWQ
LOC_Os03g56950.3      (717) YMNHSM---------PNHIPLNSSPAMNPMNVANQMQNIQLREA----SNPFLHPDGWQ
LOC_Os03g56950.4      (719) YMNHSM---------PNHIPLNSSPAMNPMNVANQMQNIQLREA----SNPFLHPDGWQ
LOC_Os03g56950.1      (715) YMNHSM---------PNHIPLNSSPAMNPMNVANQMQNIQLREA----SNPFLHPDGWQ
LOC_Os03g56950.2      (721) YMNHSM---------PNHIPLNSSPAMNPMNVANQMQNIQLREA----SNPFLHPDGWQ
```

FIG. 14J

| | | | |
|---|---|---|---|
| Solyc04g078690.2.1 | (655) | DMCR-DNTLSRLHLDMSCSGNNS---------------------------- | -S-SGVSS-------------- |
| GRMZM2G017349_T01 | (645) | MMLP-GEVVAKHQLTSIQGRVSM---------------------------- | -P-GIGMNPIRQESSTVKAD |
| Bradi1g48400.1 | (627) | MVFR-GEIMPKHQITLAQDRANL---------------------------- | -P-GNKMDSVRQEPPMSNTD |
| LOC_Os06g06900.1 | (643) | MVFH-GEIMPKHHLSSHQESL------------------------------ | -P-GNEMNSIRKESSMLNTN |
| AT5G67110.1 | (665) | GMCFSTATLL---------------------------------------- | ---------------------- |
| GSVIVT01009467001 | (639) | EICH-EEALPEPQGEMNCSRKNS---------------------------- | -S-SGVSS-------------- |
| POPTR_0014s02590.1 | (631) | EICR--EGTPQAKLEMNQTTKTS---------------------------- | -P-SGVA--------------- |
| clementine0.9_017382m | (649) | EIC---SEGAPHLHLDMNFNGKNS--------------------------- | -S-SGVS--------------- |
| clementine0.9_017468m | (651) | EICS--EGAPHLHLDMNFNGKNS---------------------------- | ---SSGVS-------------- |
| Solyc02g093280.2.1 | (633) | KEIWREDDLPLYGMNELTTKTAS---------------------------- | TGSNLAFSVPLDTDASNLK |
| AT4G36930.1 | (625) | EMSR-EGGLTHPRLNIGHSNANI---------------------------- | ---TGEQALFDGQPDLKDRI |
| POPTR_0005s18280.1 | (659) | GFY----------------------------------------------- | ---------------------- |
| LOC_Os02g56140.1 | (653) | MIYP-DEMMLKHRLTSASESTIV---------------------------- | -P-GTDEKSVRQNTYMMNAD |
| clementine0.9_029807m | (641) | --------------------------------------------------- | ---------------------- |
| GRMZM2G030744_T02 | (661) | MIFDEADMMLKHRLASGRETTSL---------------------------- | -P-GHEAKPGRQEACMVNSD |
| GRMZM2G030744_T03 | (663) | MIFDEADMMLKHRLASGRETTSL---------------------------- | -PVGHEAKPGRQEACMVNSD |
| GSVIVT01022111001 | (637) | DICR-EDVLPHQQLNISCAGTNSLELKMETTITVSLPYDAQA- | SGVKDSNTLESCIQRRD |
| Glyma01g39450.1 | (629) | --------------------------------------------------- | ---------------------- |
| Glyma11g05810.1 | (647) | EPIRGEDILQHQQSSGIHSDANTLGGSQVVKEFESGTRLSFPFDTQACEPKDNSNSSQPC | |
| AT2G20180.2 | (689) | DPYQQFRGLHPTQPPQFQNQATS---------------------------- | YPSSSRVSSSKESEDHGNHT |
| Glyma03g32740.1 | (691) | DPYQQYLGPHQMQFQLIQNQAMN---------------------------- | -Q-PNVSKPSNNGGPANPEN |
| Glyma10g04890.1 | (693) | DPYQQYLSLQQAQLQLMQTMNQP---------------------------- | -N-VSKPSTSRGQENPEKHQ |
| Glyma13g19250.1 | (695) | DPYQQYLGLQQAQLQLMQTMNQQ---------------------------- | -N-VSKPSSSRGQENPEKHQ |
| LOC_Os03g43810.1 | (725) | MPPPENAPNTGSGMGSFYFYFYF---------------------------- | ---SSD--------------- |
| LOC_Os03g56950.7 | (723) | TVPPQDHMLLGLK------------------------------------- | ---------------------- |
| LOC_Os03g56950.3 | (717) | TVPPQVSGPYASGPQVAQQNQIP---------------------------- | -K-ASASTVLPNSGAEQPPT |
| LOC_Os03g56950.4 | (719) | TVPPQVSGPYASGPQVAQQNQIP---------------------------- | -K-ASASTVLPNSGAEQPPT |
| LOC_Os03g56950.1 | (715) | TVPPQVSGPYASGPQVAQQNQIP---------------------------- | -K-ASASTVLPNSGAEQPPT |
| LOC_Os03g56950.2 | (721) | TVPPQVSGPYASGPQVAQQNQIP---------------------------- | -K-ASASTVLPNSGAEQPPT |

FIG. 14K

| Sequence | Position | Sequence |
|---|---|---|
| Solyc04g078690.2.1 | (655) | ------------------------------------- |
| GRMZM2G017349_T01 | (645) | QFDGCSHSKE--------------------------- |
| Bradi1g48400.1 | (627) | HFDGCSRSKEHPQDIIPTNTRHA--------------- |
| LOC_Os06g06900.1 | (643) | NFDGVSLSKEQS-------------------------- |
| AT5G67110.1 | (665) | ------------------------------------- |
| GSVIVT01009467001 | (639) | ------------------------------------- |
| POPTR_0014s02590.1 | (631) | ------------------------------------- |
| clementine0.9_017382m | (649) | ------------------------------------- |
| clementine0.9_017468m | (651) | ------------------------------------- |
| Solyc02g093280.2.1 | (633) | RSTREACLLRYQFGAVNETNLDCDQLLSQQLYSNF---- |
| AT4G36930.1 | (625) | T------------------------------------- |
| POPTR_0005s18280.1 | (659) | ------------------------------------- |
| LOC_Os02g56140.1 | (653) | RFDRYALSKDQLQHIMPKNTESVLDMPHLQR-------- |
| clementine0.9_029807m | (641) | ------------------------------------- |
| GRMZM2G030744_T02 | (661) | ISNRGSLGKEVFMPYLHSLQSGDTEGGLRAGSN------ |
| GRMZM2G030744_T03 | (663) | ISNRGSLGKEVFMPYLHSLQSGDTEGGLRAGSN------ |
| GSVIVT01022111001 | (637) | LSEGMLLKNIEHNQVPFPQLNGMHTGRSVPNDDMKTDRLDF |
| Glyma01g39450.1 | (629) | ------------------------------------- |
| Glyma11g05810.1 | (647) | IGGRDHSGVIIRNSETNIVGR------------------ |
| AT2G20180.2 | (689) | TG------------------------------------- |
| Glyma03g32740.1 | (691) | H-------------------------------------- |
| Glyma10g04890.1 | (693) | SDKT---------------------------------- |
| Glyma13g19250.1 | (695) | SGKVPL-------------------------------- |
| LOC_Os03g43810.1 | (725) | ------------------------------------- |
| LOC_Os03g56950.7 | (723) | ------------------------------------- |
| LOC_Os03g56950.3 | (717) | SDGI---------------------------------- |
| LOC_Os03g56950.4 | (719) | SDGI---------------------------------- |
| LOC_Os03g56950.1 | (715) | SDGI---------------------------------- |
| LOC_Os03g56950.2 | (721) | SDGI---------------------------------- |

| Sequence ID | | Alignment |
|---|---|---|
| LOC_Os01g50110.1 | (860) | ------RWSLIAGRLPGRTDNEIKNYWNSHLSKKLIAQGIDPRT |
| GRMZM2G395672_T01 | (862) | ------RWSLIAGRLPGRTDNEVKNYWNSHLSKKLVARGIDPRT |
| POPTR_0019s05190.1 | (854) | ------RWSMIAGRIPGRTDNEIKNYWNTCLSKKLISQGIDPRT |
| POPTR_0019s05200.1 | (856) | ------RWSMIAGRIPGRTDNEIKNYWNTCLSKKLISQGIDPRT |
| POPTR_0019s05210.1 | (858) | ------RWSMIAGRIPGRTDNEIKNYWNTCLSKKLISQGIDPRT |
| POPTR_0013s05300.1 | (850) | ------RWSLIAGRIPGRTDNEIKNYWNTHLSKKLISQGIDPRT |
| POPTR_0013s05310.1 | (852) | ------RWSLIAGRIPGRTDNEIKNYWNTHLSKKLISQGIDPRT |
| Solyc01g005660.1.1 | (848) | ------RWSLIAGRIPGRTDNEIKNYWNTHLSKKLINQGIDPRT |
| POPTR_0001s04240.1 | (844) | ------RWSLIAGRIPGRTDNEIKNYWNTHLSKKLISQGIDPRT |
| POPTR_0003s21120.1 | (846) | ------RWSLIAGRIPGRTDNEIKNYWNTHLSKKLISQGIDPRT |
| AT3G13540.1 | (838) | ------RWSLIAGRIPGRTDNEIKNYWNTHLRKKLLRQGIDPQT |
| Glyma13g09980.1 | (840) | ------RWSLIAGRIPGRTDNEIKNYWNSHLSKKLISQGIDPRT |
| Glyma14g24500.1 | (842) | ------RWSLIAGRIPGRTDNEIKNYWNSHLSKKLINQGIDPRT |
| POPTR_0002s19920.1 | (747) | ------RWSLIASYLPGRTDNEIKNYWNSHLSRIHSFRR--SA |
| POPTR_0014s11780.1 | (749) | ------RWSLIASHLPGRTDNEIKNYWNSHLSRIYSFRR--PV |
| LOC_Os03g19120.1 | (775) | VKRMDYVCLGARDYCFQQNTHVRWSLIASHLPGRTDNEIKNYWNSHLSRQIHTYRRTYTA |
| Si039538m | (783) | ------RWSLIASHLPGRTDNEIKNYWNSHLSRQIHTYRRTYTA |
| GRMZM2G022686_T01 | (777) | ------RWSLIASHLPGRTDNEIKNYWNSHLSRQIHTYRRKYTA |
| GRMZM2G057027_T02 | (779) | ------RWSLIASHLPGRTDNEIKNYWNSHLSRQIHTYRRKYTA |
| GRMZM2G084799_T01 | (781) | ------RWSLIASHLPGRTDNEIKNYWNSHLSRQIHTYRRKYTA |
| LOC_Os01g19970.1 | (767) | ------RWSLIAGHLPGRTDNEIKNYWNSHLSRKGYEFLRGGGG |
| GRMZM2G051528_T01 | (771) | ------RWSLIAGHLPGRTDNEIKNHWNSHLRR----GRAGDS |
| GRMZM2G051256_T01 | (769) | ------RWSLIAGHLPGRTDNEIKNYWNSHLSRRAADFRD--- |
| Si002107m | (773) | ------RWSLIAGHLPGRTDNEIKNYWNSHLSRRAADFRD--- |
| POPTR_0010s15090.1 | (751) | ------RWSFIAAQLPGRTDNEIKNYWNSHLSRKIYSFNR-YKN |
| Glyma02g01740.1 | (741) | ------RWSLIANHLPGRTDNEIKNYWNSHLRKIYSFPGAGAG |
| Glyma03g37640.1 | (743) | ------RWSLIASHLPGRTDNEIKNYWNSHLRKIYTFHGTTST |
| Glyma19g40250.1 | (745) | ------SWSLIASHLPGRTDNEIKNYWNSHLSRKIYTFHGK-- |
| AT5G49330.1 | (735) | ------RWSLIATHLPGRTDNEIKNYWNSHLSRKIYAFTAVSGD |
| AT3G62610.1 | (739) | ------RWSTIASNLPGRTDNEIKNYWNSHLSRKLHGYFRKPTV |
| AT2G47460.1 | (737) | ------RWSLIAGHLPGRTDNEIKNYWNSHLSRKLHNFIRKPSI |
| Glyma09g04370.1 | (763) | ------RWSLIAGVLPGRTDNEIKNYWNSHLRRKIYCFMRSLNE |
| Glyma15g15400.1 | (765) | ------RWSVIAGRLPGRTDNEIKNYWNSHLRRKIYCFMR--SL |
| Glyma07g37140.1 | (759) | ------RWSVIAGHLPGRTDNEIKNYWNSHLRRKIYCFMK--SL |
| Glyma17g03480.1 | (761) | ------RWSLIAEHLSGRTDNEIKNYWNSHLSRKIYCFMK--SL |
| Solyc01g079620.2.1 | (753) | ------RWSLIAEHLSGRTDNEIKNYWNSHLSRKVDSLRI--PS |
| Solyc06g009710.2.1 | (755) | ------RWSLIAEHLPHRTDNEIKNYWNSHLRRKVDSFRI--PG |
| Solyc12g049350.1.1 | (757) | ------RWSLIAEYLPHRTDNEIKNYWNSRLCRKVESLRI--PS |
| Consensus | (834) | xWSxIAxxXxxxRTDNExKNxWNxxLxxX |

SANT2

| Identifier | Position | Sequence |
|---|---|---|
| LOC_Os01g50110.1 | (860) | AADAEGFEGGFGDQFCAEDAVHGG--------------------------------- |
| GRMZM2G395672_T01 | (862) | --MGLGSEGFDGVGDPFCAPAPGG--------------------------------- |
| POPTR_0019s05190.1 | (854) | WPNRDGFTMGSLQS-GHGRKNEDD--------------------------------- |
| POPTR_0019s05200.1 | (856) | WPNRDGFNMGSLQS-GYGRKNEDD--------------------------------- |
| POPTR_0019s05210.1 | (858) | WPNRDGFNMGSLQS-GYGRKNEDD--------------------------------- |
| POPTR_0013s05300.1 | (850) | WPSCDGFNKGLQ---SHHEQNKEE--------------------------------- |
| POPTR_0013s05310.1 | (852) | WPSCDGFNKGLQ---SHHEQNKEE--------------------------------- |
| Solyc01g005660.1.1 | (848) | TSPDDDYQYQSSNVMLANYRDDDM--------------------------------- |
| POPTR_0001s04240.1 | (844) | LLNYDGTSGMDLKGDQSLGIGEAD--------------------------------- |
| POPTR_0003s21120.1 | (846) | LLNYDGSFGTDLRGNQRLGNGEAE--------------------------------- |
| AT3G13540.1 | (838) | KNSINVFGGEHGY--------------------------------------------- |
| Glyma13g09980.1 | (840) | PAAATGDVSAMAFMDNNNEDCNDD--------------------------------- |
| Glyma14g24500.1 | (842) | AAATDDVSAMGFMDNNNEDCNNDG--------------------------------- |
| POPTR_0002s19920.1 | (747) | TPAIEKETLSSAIN-DTVIWDPCE---------------------------DDKEQMD |
| POPTR_0014s11780.1 | (749) | TPAAEKNTLSSTIN-DTVIWDPCAEDKELMDLVVTTPCPETGRVMLGSSGEKANLVICPG |
| LOC_Os03g19120.1 | (775) | QPNNGSSGGGGGTPDGPCSEETAT--------------------------------- |
| Si039538m | (783) | ASSPRHSDGARSAVVDPDQNQPDS--------------------------------- |
| GRMZM2G022686_T01 | (777) | DPNQPNSSSG----------------------------------------------- |
| GRMZM2G057027_T02 | (779) | QPNSSSGSTGTA--------------------------------------------- |
| GRMZM2G084799_T01 | (781) | QPNSSSGSTGTAEEEGPS--------------------------------------- |
| LOC_Os01g19970.1 | (767) | VSAASHSHREEQAQASASGLTSDG--------------------------------- |
| GRMZM2G051528_T01 | (771) | SHCASAAQSEEQAQASASGLTSEE--------------------------------- |
| GRMZM2G051256_T01 | (769) | DDCGTAQSEEEQAQASASGLTSDG--------------------------------- |
| Si002107m | (773) | QPCATDKSGEEQAQASASGVTSDD--------------------------------- |
| POPTR_0010s15090.1 | (751) | ISHCPINDEKETETLGPYEWLDSE--------------------------------- |
| Glyma02g01740.1 | (741) | FDEPRTEELEAEVNKHILGLCELE--------------------------------- |
| Glyma03g37640.1 | (743) | ------EGEKEEIINEDIWGPCD---------------------------------- |
| Glyma19g40250.1 | (745) | QVDGSSTASEKEEILNDDIWGPYV--------------------------------- |
| AT5G49330.1 | (735) | LGPYEWLDGELERLLSSCVWECTS--------------------------------- |
| AT3G62610.1 | (739) | VLSSSSLSGAEFPGLGPCGYGDDG--------------------------------- |
| AT2G47460.1 | (737) | DYYGDDCNKNLMSINGDNGVLTFD--------------------------------- |
| Glyma09g04370.1 | (763) | YPSLEDSLG------PYHHWSDDE--------------------------------- |
| Glyma15g15400.1 | (765) | CPSLEASLG------PYHHWSDDE--------------------------------- |
| Glyma07g37140.1 | (759) | CPSIDEVEAL-----GPYQWLDDE--------------------------------- |
| Glyma17g03480.1 | (761) | LSSMDEVEAL-----GPYQWLDDE--------------------------------- |
| Solyc01g079620.2.1 | (753) | SWAGPIEAKGSLSSDSIEWPRLE---------------------------------- |
| Solyc06g009710.2.1 | (755) | -------DQMLWHDDI----------------------------------------- |
| Solyc12g049350.1.1 | (757) | IPNGDNNATEFDHNDDQMLWHDDI--------------------------------- |

FIG. 16F

FIG. 16G

```
LOC_Os01g50110.1    (860) ---------------------------------GDLFVVEGNDHEHGNGEIGHGDVMESKQ------------
GRMZM2G395672_T01   (862) ---------------------------------RDADGGNDQGAY------------------------------
POPTR_0019s05190.1  (854) SS-------------------------------KLAVSSSQILSHANIWEAEVSPPMAALC--------------
POPTR_0019s05200.1  (856) SS-------------------------------KLAVSSSQILSHANIWEAEVSPPMA---------------AL-
POPTR_0019s05210.1  (850) SS-------------------------------KLAVSSSQILSHENIWEAEVSPPMA---------------AL-
POPTR_0013s05300.1  (852) ---------------------------------QPVISSSQAFHHGSIWEAEVTSSMAAF---------------
POPTR_0013s05310.1  (848) PSG------------------------------EPMISSSQAIHHSSISEAEVAYSMA--------------AF-
Solyc01g005660.1.1  (844) ---------------------------------TLQDFDHFMASSSPSYDQNNLKTMDE----------------
POPTR_0001s04240.1  (846) SSD------------------------------PFVSIAATTFGLGTGWESTLMSSA------------------
POPTR_0003s21120.1  (838) STDP-----------------------------LFPIAAATSFGLSTGWESTLMPSA------------------
AT3G13540.1         (840) ---------------------------------QPLQMDDCKDGIVGASSSSLGHD-------------------
Glyma13g09980.1     (842) RSIM-----------------------------NPLPCDDRVGGHLGSIATASAAQANTLT------------IT-
Glyma14g24500.1     (747) ---------------------------------NPLPCDDRVDDHHLGSITTASASQGYDDELGVLW--------
POPTR_0002s19920.1  (749) DGLVVRSEERENGVLSPNKTV--YDSIGYLSSNGESGEWHSCSSISISGFD---------------------DW-
POPTR_0014s11780.1  (775) NGLLVHSGERQSGVSSPDKTVDVFESIGDLSSNGESCDWHSFSSISTSGFDDCGVDW------------------
LOC_Os03g19120.1    (783) E--------------------------------PLDVAAQADDLLDMDWDGFAAD-----------------LW-
Si039538m           (777) PLTGFVD--------------------------AVGEAGQVDDLLDMDWDGFAAH-----------------IW-
GRMZM2G022686_T01   (779) TAEGF----------------------------DAAQAQVDDLFDDMDWDNFAAH-----------------LW-
GRMZM2G057027_T02   (781) ALQGLG---------------------------AVGGEAQVDDLFDMDWDGFAAH-----------------LW-
GRMZM2G084799_T01   (767) ALEGLG---------------------------AVGCEAQVDDLFDMDWDGFAAH-----------------LW-
LOC_Os01g19970.1    (771) ---------------------------------PTEAVGQDMGDKSMDWDLVGLDDGFANDD----------MW-
GRMZM2G051528_T01   (769) GGPSG----------------------------DVAQELHLDDDAIMDWDSMGLDIPTADD-----------TW-
GRMZM2G051256_T01   (773) SSGPSGD--------------------------VAQDLDLDDDKAIMDWDLMGLDISTAGD-----------MW-
Si002107m           (751) SGPGGPIG-------------------------DVAQELGENDKAIMDWDLMALDISTAGD-----------MW-
POPTR_0010s15090.1  (741) KKQS-----------------------------NSSNGCSSNEESNGEWYNSFSPMNPRFDEEWLDW-------
Glyma02g01740.1     (743) A--------------------------------SSEEGSCSSMNQDWDWESVLEFSNAVD-----------NW-
Glyma03g37640.1     (745) NIVMSSGDDDQLH--------------------SSSFMASGLDQNLLTW-----------------------LW-
Glyma19g40250.1     (735) VIMSSGDHDRLH---------------------SSSSIASDLDQNLLTW-----------------------LW-
AT5G49330.1         (739) GSFLSSNSNENNDKDWWVGLC------------NSSEVGFGVDEELLDWEFQGNVTCQSDD----------LW-
AT3G62610.1         (737) YGGMS----------------------------VGHKNIETMADDFVDWDFVWREGQT-----------LWDEK
AT2G47460.1         (763) LQSCPSVESFLN---------------------YDHQVNDASTDEFIDWDCVWQEGSDNN---------LWHEK
Glyma09g04370.1     (765) NVDVMGIDQS-----------------------KNNGVWNSSNGESGEWYPNCSSVNSVIDYQWSDWDMG
Glyma15g15400.1     (759) N--------------------------------WSDWDMGGSVQSNNQWNLCDDQVMNC-----------LW---
Glyma07g37140.1     (761) SCSSVNSVYDYHHYQ------------------WPDMQLEGSVQSYNPWDLCEENQNVANC---------FW---
Glyma17g03480.1     (753) KLL------------------------------PDMQLEGSVQDSYNPWDFCEENQNEANC---------FW---
Solyc01g079620.2.1  (755) ---------------------------------MDWQDNDELVWPTLPWELETDIVP---------SWPQW
Solyc06g009710.2.1  (757) ---------------------------------NNNEILSEDNYGKWDWEYLSEILNNEICGNSTKE-------
Solyc12g049350.1.1       ---------------------------------EILNVDNHGILDGWDWEYLDEMLNNE---------------
```

FIG. 16H

| Sequence | Pos | Alignment |
|---|---|---|
| LOC_Os01g50110.1 | (860) | ------------------------------ |
| GRMZM2G395672_T01 | (862) | ------------------------------ |
| POPTR_0019s05190.1 | (854) | DKG------VGGASNSLPV----------- |
| POPTR_0019s05200.1 | (856) | GDKG-----VGGASNSLPV----------- |
| POPTR_0019s05210.1 | (858) | GDKG-----VGGASNRLPV----------- |
| POPTR_0013s05300.1 | (850) | GEKD-----GALNSDDLA------------ |
| POPTR_0013s05310.1 | (852) | GEKD-----GVLNSHDLA------------ |
| Solyc01g005660.1.1 | (848) | ---------FNQNESK-------------- |
| POPTR_0001s04240.1 | (844) | ---------FNQNESK-------------- |
| POPTR_0003s21120.1 | (846) | ---------LDQNDSK-------------- |
| AT3G13540.1 | | |
| Glyma13g09980.1 | (840) | SPRG-----FMITTINSI------------ |
| Glyma14g24500.1 | (842) | ESPL-------------------------- |
| POPTR_0002s19920.1 | (747) | IWDDVMGGHVEGGGDHLIQE----------------------------DNMLSCLWESDQVEWGGGT |
| POPTR_0014s11780.1 | (749) | SWDD------VMGGHLEIGDETKEENM---LSWLWENEKGEEVVNYEKQNAMLLGFFLDL |
| LOC_Os03g19120.1 | (775) | GDPAQRGGLVQDAGEPNGSM----------------------------GCSSDELESFASWLLSDS |
| Si039538m | (783) | GDHPTAQVQQQNDDQSTLL-----------QPDGPQAAAGCNEHQEDELESFATWLLSDS |
| GRMZM2G022686_T01 | (777) | GEPEQ------QNDHSAQPQPQQAAEPQAAAADVAAAGAEACDPDEHELEALETWLLSDS |
| GRMZM2G057027_T02 | (779) | GGPE-------QDDHSAQLRQAAEPMEA-AAVAAAAAAATAACTPDDRELEAFETWLLSDS |
| GRMZM2G084799_T01 | (781) | GGPE-------QDEHSAQLRQ-----AAEPLEVAAAAAATAARTPDDRELEAFETWLLSDS |
| LOC_Os01g19970.1 | (767) | GSLS-------WDYGELVGPD--------------------GVHQGEVLSDLFFLGN |
| GRMZM2G051528_T01 | (771) | NPLV-------WDYDQTSLVP--------------------EPEGEGRRQRDEMMSDLFFLDN |
| GRMZM2G051256_T01 | (769) | DQLV-------WDYDETLVTE--------------------PEGGEEGHQQQDDVMSDLFFLDN |
| Si002107m | (773) | DPLV-------WDYADMDIVV--------------------PDGGHQQQQEDVVSDLFFLDN |
| POPTR_0010s15090.1 | (751) | DWTIAGDLGGWGLL-------------------------------- |
| Glyma02g01740.1 | (741) | EDQDKLLIWLWEDDDCKRLG----------------ETDIQILQNDMVIDWFLS-- |
| Glyma03g37640.1 | (743) | EDED------WETDLQSLGE----------------IHSDKLKAMVDWFLSSS |
| Glyma19g40250.1 | (745) | EDED------WEKDLQSLGE----------------IHSDKLKAMVDWFLSSS |
| AT5G49330.1 | (735) | DLSD------IGEITLE----------------------- |
| AT3G62610.1 | (739) | EDLDSVLSRLLDGEEMESEI------------RQRDSNDFGEPLDIDEENKMAAWLLS-- |
| AT2G47460.1 | (737) | ENPDSMVSWLLDGDDEATIG------------NSNCENFGEPLDHDDESALVAWLLS-- |
| Glyma09g04370.1 | (763) | GSVQSNNQ--WNLCDDQVMN-------------------CLWSTGIGEINYGFH |
| Glyma15g15400.1 | (765) | STGI------GEINYGFHP------------------------ |
| Glyma07g37140.1 | (759) | GTG-------HNEGNGFYQ------------------------ |
| Glyma17g03480.1 | (761) | GTTG------HNEGNGFYQ------------------------ |
| Solyc01g079620.2.1 | (753) | DDTDTNLLQNCTNDNNNYEE----------------ATTMEINNQNHSTIVSWLLS-- |
| Solyc06g009710.2.1 | (755) | NNN-------NNNNMSLCD----------------INDNVQNCMNKEATQENIDPMQSDLVAWLLS-- |
| Solyc12g049350.1.1 | (757) | ----------IENNNVSNID-----------------------PMNSDLVAWLLS-- |

Fig. 16I

| | | |
|---|---|---|
| LOC_Os01g50110.1 | (860) | – – |
| GRMZM2G395672_T01 | (862) | – – |
| POPTR_0019s05190.1 | (854) | – – |
| POPTR_0019s05200.1 | (856) | – – |
| POPTR_0019s05210.1 | (858) | – – |
| POPTR_0013s05300.1 | (850) | – – |
| POPTR_0013s05310.1 | (852) | – – |
| Solyc01g005660.1.1 | (848) | – – |
| POPTR_0001s04240.1 | (844) | – – |
| POPTR_0003s21120.1 | (846) | – – |
| AT3G13540.1 | (838) | – – |
| Glyma13g09980.1 | (840) | – – |
| Glyma14g24500.1 | (842) | – – |
| POPTR_0002s19920.1 | (747) | GL |
| POPTR_0014s11780.1 | (749) | PQ |
| LOC_Os03g19120.1 | (775) | C– |
| Si039538m | (783) | F– |
| GRMZM2G022686_T01 | (777) | F– |
| GRMZM2G057027_T02 | (779) | F– |
| GRMZM2G084799_T01 | (781) | F– |
| LOC_Os01g19970.1 | (767) | L– |
| GRMZM2G051528_T01 | (771) | L– |
| GRMZM2G051256_T01 | (769) | L– |
| Si002107m | (773) | M– |
| POPTR_0010s15090.1 | (751) | – – |
| Glyma02g01740.1 | (741) | – – |
| Glyma03g37640.1 | (743) | – – |
| Glyma19g40250.1 | (745) | – – |
| AT5G49330.1 | (735) | – – |
| AT3G62610.1 | (739) | – – |
| AT2G47460.1 | (737) | – – |
| Glyma09g04370.1 | (763) | P– |
| Glyma15g15400.1 | (765) | – – |
| Glyma07g37140.1 | (759) | – – |
| Glyma17g03480.1 | (761) | – – |
| Solyc01g079620.2.1 | (753) | – – |
| Solyc06g009710.2.1 | (755) | – – |
| Solyc12g049350.1.1 | (757) | – – |

Fig. 16J

```
Bradi1g12870.1      (878)  ------------------------------------PPPSPSPSPSPQ----APQAPP--
LOC_Os03g46440.1    (884)  -----------METSTVTSSSS----------------------SPPSPP----PPQPAP--
LOC_Os03g46440.2    (886)  -----------METSTISFSSS----------------------SPPSPP----PPQPAP--
LOC_Os03g46440.3    (880)  -----------METSTISFSSS----------------------SPPSPP----PPQPAP--
Si034834m           (882)  -----------METSTISFSSS----------------------SPPSPP----PPQPAP--
GRMZM2G115162_T01   (888)  -----------MEASTISFSSP--SS--------SPQSTPPPP---PPRATP--
Bradi2g51030.1      (874)  -----------MEVSTISFSS----------------P----PPRATP--
LOC_Os01g56200.1    (876)  -----------MEPSSSITFASS-------SSYLSNGSSPYSAALPPPG----ATQAAPLI
GRMZM2G076450_T01   (866)  MPARSAVVVIAMEPSSSITIASS-------SSYLSNGSSPCSVSLAPPGAGAVAAQAAPVA
Si000647m           (868)  -----------MEPSSSITFASS-------SSYLSNGSSPCSVALPPPG----PPQTPPLP
Si000671m           (870)  -----------MEPSSSITFASS-------SSYLSNGSSPCSVALPPPG----PPQAPPLI
Solyc07g044980.2.1  (872)  -----------MESGHESFATS-------------SNVSNECSS----PQEPG--
Eucgr.A02033.1      (900)  -----------MEYENGLSSPSS-------YLSNGS--TDHDAAVPVM----NPESG--
Eucgr.A02033.2      (902)  -----------MEYENGLSSPSS-------YLSNGS--TDHDAAVPVM----NPESG--
AT5G45110.1         (864)  ----MATLTEPSSSLSFTSS-------HFSYGSIGSNHFSSSSA-----------
Solyc02g069310.2.1  (910)  ----MASSAEPSSSISFTST----S-NTSNGSIGIGQNTCACG----GSETG--
Eucgr.E01922.1      (916)  ----MAFSMEPSSSLSFTSS----S-HLSNNS--VSNNAVGPY----GSETG--
Glyma09g02430.1     (918)  ----MAYSAEPSSSLSFTSS----S-HLSNGS--VSHNICPSY----GSDPG--
Glyma15g13320.1     (922)  ----MAYSAEPSSSLSFTSS----S-HLSNGS--VSHNICSSY----GSDPG--
POPTR_0015s15800.1  (908)  ----MANFSEPSSSLSYTSS----S-HLSNGS--ISHNISNSS----GAEAG--
POPTR_0012s11900.1  (920)  ----MANFSELSSSSLSFTSS----S-HMSNGS--ISHNISNSS----VAEAG--
Glyma14g03510..1    (896)  ----MDNSYDSSSSLSFVSS----HLSHGS--SNHNVSSTT----SNEHG--
Glyma02g45260.1     (894)  ----MDNSNDSSSSLSFVSS----MDHGS--SNHNVSSST----SNEHG--
Glyma02g45260.2     (898)  ----MDNSNDSSSSLSFVSS----RLSHGS--SNHNVSSST----SNEHG--
POPTR_0005s22770.1  (906)  ----MENAIETISSFSFDSS-------S-YLSKGP--SSHRVPIPD----VPEPG--
clementine0.9_005201m (890)  ----MENANEKSASLSFVSSYPTCWSTNQSTDTCDLDDLNMVLDGIMENANEKS---
clementine0.9_005587m (892)  -MVLDSIMENANEMSSSLSFASS----S-YLSNGS--TNH----PA--SPELC--
```

FIG. 18A

| | | |
|---|---|---|
| Bradi1g12870.1 | (878) | ----------ANLDAVSLGRLSANLERLLDPAFLN----------CADAE |
| LOC_Os03g46440.1 | (884) | ----------GDIDAVSLGRLSRNLENLLDPAFLN----------CADAE |
| LOC_Os03g46440.2 | (886) | ----------GDIDAVSLGRLSRNLENLLDPAFLN----------CADAE |
| LOC_Os03g46440.3 | (880) | ----------GDIDAVSLGRLSRNLENLLDPAFLN----------CADAE |
| Si034834m | (882) | ----------TELEAVRLRRLSDNLERLLDPAFLN----------CADAE |
| GRMZM2G115162_T01 | (888) | ----------ADLEAVGLRRLSDNLQRLLDPAFLN----------CSDAE |
| Bradi2g51030.1 | (874) | PSEGYGGGGGGGS--SSLEVVSLNRLSNNLERLLESDLD----------CSDAD |
| LOC_Os01g56200.1 | (876) | AGEGGGGGGGGGGGSSVEVVSLNRLSANLERLLLDSDLD----------CSDAD |
| GRMZM2G076450_T01 | (866) | AGQGWGGGVAAAGSG-GSVEAVSLNRLSKNLERLLDPDLD----------CSDAD |
| Si000647m | (868) | AGDGWGSGGAAGGSS-SNVEAVSLNRLSKNLERLLIDEDLD----------CSDAD |
| Si000671m | (870) | AGDGWGSGGAAGGSS-SNVEAVSLNRLSKNLERLLIDEDLD----------CSDAD |
| Solyc07g044980.2.1 | (872) | ----------PNVD--HLSNLCGSLEKLLLNPEYD----------YSDAE |
| Eucgr.A02033.1 | (900) | ----------YNPDLLSLTKLSDSLDKLLCDDDYG----------YTDAV |
| Eucgr.A02033.2 | (902) | ----------YNPDLLSLTKLSDSLDKLLCDDDYG----------YTDAV |
| AT5G45110.1 | (864) | ----------SNPEVVSLTKLSSNLEQLLSNSDCD----------YSDAE |
| Solyc02g069310.2.1 | (910) | ----------SSYEIISLSKLSNNLEQLLDSSSE----------FSDAE |
| Eucgr.E01922.1 | (916) | ----------HSPDAISLGKLSSSLERLLSDSTPD----------YSDAD |
| Glyma09g02430.1 | (918) | ----------PNLEAISLSKLSSNLEQLLIEPDCD----------YSDAD |
| Glyma15g13320.1 | (922) | ----------PNLEALSLSKLSSNFEQLLIETDCD----------YSDAD |
| POPTR_0015s15800.1 | (908) | ----------TSLEVISLNKLSSNLEQLLIDSTCD----------YSDAD |
| POPTR_0012s11900.1 | (920) | ----------TSLEVISLNKLSSSLEQLLIESTCE----------YSDAD |
| Glyma14g03510..1 | (896) | ----------ENIEILSLNKLSGSLEKLLIEVEYD----------YSDAE |
| Glyma02g45260.1 | (894) | ----------ANIEILSLNKLSGSLEKLLIETEYD----------YSDAE |
| Glyma02g45260.2 | (898) | ----------ANIEILSLNKLSGSLEKLLIETEYD----------YSDAE |
| POPTR_0005s22770.1 | (906) | ----------VSLENFSLSKLSGNLERLLDGEYD----------YSDAE |
| clementine0.9_0052Ol1m | (890) | ASLSFVSSNPTCWSTNQSTDTCDLDDNLRMQSSNPKETWHDAE |
| clementine0.9_005587m | (892) | ----------SSLDNLSLSKLSSNLEKLLLDAEYD----------YTDAE |
| Consensus | (981) | DAx |

BTB Domain

FIG. 18B

| | | | |
|---|---|---|---|
| Bradi1g12870.1 | (878) | VVLADG----GDEATVPVHRCILAARSNFFLDHF-SSLSSPA------------AG |
| LOC_Os03g46440.1 | (884) | IVLASGGGDPGGGAVVGVHRCILAARSRFFYDHF-SSAPAPAPA----------TA |
| LOC_Os03g46440.2 | (886) | IVLASGGGDPGGGAVVGVHRCILAARSRFFYDHF-SSAPAPAPA----------TA |
| LOC_Os03g46440.3 | (880) | IVLASGGGDPGGGAVVGVHRCILAARSRFFYDHF-SSAPAPAPA----------TA |
| Si034834m | (882) | VALAAG----KGGAAVGVHRCILAARSAFFRDHF-ASLPPPA------------AV |
| GRMZM2G115162_T01 | (888) | IALAAA----RGGGAVGVHRCILAARSAFFLDHL-ASLPAPA------------AA |
| Bradi2g51030.1 | (874) | VDMADG--------GPLVPVHRCILAARSPFFHEFFAARGRGNSGDGPPSASAAGVGGGGEG |
| LOC_Os01g56200.1 | (876) | VDVADG--------GPPVPVHRCILAARSTFFYNLFAARGRGGDGAAGGGGGGGGGE-RI |
| GRMZM2G076450_T01 | (866) | VDVPDG--------GPPVPIHRCILAARSDFFYDLFAARGRAGAARGDAAAGAGVAAEG-AA |
| Si000647m | (868) | IEVPDG--------GPPVPVHRCILAVRSPFFYDIFAARGRGGAARGDAAAGARGAGEG-AA |
| Si000671m | (870) | IEVPDG--------GPPVPVHRCILAVRSPFFYDIFAARGRGGAARGDAAAGARGAGEG-AA |
| Solyc07g044980.2.1 | (872) | IVVE----------GINVGVNRCILAARSQFFHEKF-KEKNENS----------LK |
| Eucgr.A02033.1 | (900) | IVVE----------GVPVGVHRCLLAARSQFLHEFF-KQGGGDN----------AR |
| Eucgr.A02033.2 | (902) | IVVE----------GVPVGVHRCLLAARSQFLHEFF-KQGGGDN----------AR |
| AT5G45110.1 | (864) | IIVD----------GVPVGVHRCILARSKFFQDLF-KKEKKIS-----------K |
| Solyc02g069310.2.1 | (910) | IVVE----------GVSLGVHRCILAARSSFFRDLF-RKRNGNC----------GK |
| Eucgr.E01922.1 | (916) | IVVE----------NISVGVHRCILAARSDFFNNLF-KREKGSS----------EK |
| Glyma09g02430.1 | (918) | LVVE----------GIPVSVHRCILASRSKFFHELF-KREKGSS----------EK |
| Glyma15g13320.1 | (922) | IVVE----------GISVSVHRCILASRSKFFHELF-KREKGSS----------EK |
| POPTR_0015s15800.1 | (908) | IVVE----------GTAIGVHRCILGARSKFFHELF-RREKGSS----------EK |
| POPTR_0012s11900.1 | (920) | IVVE----------GIAVGVHRCILASRSKFFHELF-RREKGSL----------EK |
| Glyma14g03510..1 | (896) | ILIE----------DIPVGIHRCILASRSPFFHELF-KKGTDGS----------GK |
| Glyma02g45260.1 | (894) | ILVE----------DIPVGIHRCILASRSPFFHELF-KKGTDGS----------GK |
| Glyma02g45260.2 | (898) | ILVE----------DIPVGIHRCILASRSLFFHELF-KKGTDGS----------GK |
| POPTR_0005s22770.1 | (906) | IVVE----------GIPVGVHRCILAARSQFFHELF-KKVDSNS----------TS |
| clementine0.9_005201m | (890) | IVVE----------GKSVAVNRSILSERSQFFRRLF-NLRNDGS----------VS |
| clementine0.9_005587m | (892) | IVVE----------GKSVALHRCILSARSQFFHELF-KKGNNNDGSA--------VS |
| Consensus | (981) | xxxxxxxxxxxxxxxxxxxxxxRxxLxxRSxFXxxxX |

BTB Domain

FIG. 18C

FIG. 18D

| Name | Pos | Sequence | Domain |
|---|---|---|---|
| Bradi1g12870.1 | (878) | GGKPRLELAELVPGGRHVGHEALVAVLGYLYTGRLKPPPQEAAICVDDRCRHQACRPAID | |
| LOC_Os03g46440.1 | (884) | GDKPQLDLDGLVPGGRHIGRDALVAVLSYLYTGRLRSAPPEAAACLDDGCSHDACRPAID | |
| LOC_Os03g46440.2 | (886) | GDKPQLDLDGLVPGGRHIGRDALVAVLSYLYTGRLRSAPPEAAACLDDGCSHDACRPAID | |
| LOC_Os03g46440.3 | (880) | GDKPQLDLDGLVPGGRHIGRDALVAVLSYLYTGRLRSAPPEAAACLDDGCSHDACRPAID | |
| Si034834m | (882) | GEKPRLELADLVPGGRHIGQDALVPVLGYLYTGRLKSAPQDATVCMDDACGHGACRPAID | |
| GRMZM2G115162_T01 | (888) | GERPRLELADLVPGGRHIGRDALVPVLGYLYTGRLKPPAQDATVCMDDACGHGTCRPAID | |
| Bradi2g51030.1 | (874) | TGRPRYKMEELVPGGR-VGREAFLGFMRYLYTGKLRPAPPDVVSCVDPVCPHDSCPPAIR | |
| LOC_Os01g56200.1 | (876) | GGRPRYKMEELVPGGR-VGRDAFLSLLGYLYTGKLRPAPDDVVSCADPMCPHDSCPPAIR | |
| GRMZM2G076450_T01 | (866) | SGRPRYKMEDLVPAGR-VGREAFQAFLGYLYTGKLRPAPVDVVSCADPVCHHDSCPPAIR | |
| Si000647m | (868) | SGRPRYKMEELVPGGR-VGREAFQAFLGYLYTGKLRPAPLDVVSCADPVCPHDSCPPAIR | |
| Si000671m | (870) | SGRPRYKMEELVPGGR-VGREAFQAFLGYLYTGKLRPAPLDVVSCADPVCPHDSCPPAIR | |
| Solyc07g044980.2.1 | (872) | NEKPKYLLKDLVCVSS-IGYEVFMVLLNYLYTGKIKSSPSEVSSCVDNACAHDACRPAIN | |
| Eucgr.A02033.1 | (900) | EGKPRYPISDLVKKGH-VGCEAFKYVLRYMYTGKLKLFPAEVSTCVDSSCAHDVCGPAIN | |
| Eucgr.A02033..2 | (902) | EGKPRYPISDLVKKGH-VGCEAFKYVLRYMYTGKLKLFPAEVSTCVDSSCAHDVCGPAIN | |
| AT5G45110.1 | (864) | TEKPKYQLREMLPYGA-VAHEAFLYFLSYIYTGRLKPFFLEVSTCVDPVCSHDCCRPAIN | |
| Solyc02g069310.2.1 | (910) | EGKPSYSMIDILPCGK-VGYEAFLYFLSYLYSGKLKHFPPEASTCVNSLCSHDSCRPAIN | |
| Eucgr.E01922.1 | (916) | EGKPKYNMDDLLPYGK-VGYEAFLIFLSYAYTGKLKRSPLEVSTCVDDMCSHDACSPAIN | |
| Glyma09g02430.1 | (918) | EGKLKYNMNSDLLPYGK-VGYEAFLIFLGVYVTGKLKPSPMEVSTCVDNVCAHDACRPAIN | |
| Glyma15g13320.1 | (922) | EGKLKYNMSDLLPYGK-VGYEAFLIFLGVYVTGKLKPSPMEVSTCVDNVCAHDACRPAIN | |
| POPTR_0015s15800.1 | (908) | EGKPKYCMSDLLPCGK-VGYEAFLIFLSYLYTGRLKASPTEVTTCVDETCTHDACRPAIN | |
| POPTR_0012s11900.1 | (920) | DGKPKYCMSELLPYGN-VGYEAFLIFLSYLYTGRLKASPTEVTTCVDETCTHDACRPAIN | |
| Glyma14g03510..1 | (896) | EGKPRYLMSDLMPYGT-VGYQAFQVFLYLYLYTGRLKASPTEETTCVDETCIHVACRPAIN | |
| Glyma02g45260.1 | (894) | EGKPRYLMSDLVPYGT-VGYEAFQVFLYLYLYTGRLKASPTEVTTCVDETTCVDDACVHVSCPPTIN | |
| Glyma02g45260.2 | (898) | EGKPRYLMSDLVPYGT-VGYEAFQVFLYLYLYTGRLKASPTEVTTCVDETCTHDACRPAIN | |
| POPTR_0005s22770.1 | (906) | GDKPRYLMSDLMPYGG-VGYEAFNVFLHYLYTGKHHKSSPPEVSQCVYDACAHDACRPAIN | |
| clementine0.9_005201m | (890) | EGKPKYLLTDLVPHGK-VGYEAFNDTLHYTYTGKTKAPPPEVSTCVDDACVHVSCPPTIN | |
| clementine0.9_005587m | (892) | EGKPKYLMTELVPYGK-VGYEALNVILYFYFTGKLKPSPSEVSTCVDDACAHDACPPAIN | |
| Consensus | (982) | XxxxxxxxxXxxxxxxxxxxxxxxxxXxxXxxxxxxXxxxXxxxxCxHxxxCxPXIx | BTB Domain |

| Bradi1g12870.1 | (878) | FVVESTYAASGFQISELVSLFQRRLSDFVNEALAEDILPIIHVASTCQLPDLLNQCIQRV |
|---|---|---|
| LOC_Os03g46440.1 | (884) | FVVESTYAASGFQISELVSLFQRRLSDFVNKALAEDILPILVVASTCHLPELLNQCIQRV |
| LOC_Os03g46440.2 | (886) | FVVESTYAASGFQISELVSLFQRRLSDFVNKALAEDILPILVVASTCHLPELLNQCIQRV |
| LOC_Os03g46440.3 | (880) | FVVESTYAASGFQISELVSLFQRRLSDFVNKALAEDILPILVVASTCHLPELLNQCIQRV |
| Si034834m | (882) | FVVESMYAASGFQISELVSLFQRRLSDFVSTALDEDVVPIHVASTCELQDLLNQSLQRI |
| GRMZM2G115162_T01 | (888) | FVVESMYAASGFQISELASLFQRRLSDFVCEALDEDVVPIIHVASTCDLQDLLNLCIQRV |
| Bradi2g51030.1 | (874) | FAVELMYAASTFNIPELISLFQRRLLNFVDKTLVEDVLPILQVAYDSDLGQVLEKCVQRI |
| LOC_Os01g56200.1 | (876) | FNVEQMYAAWAFKITELISLFQRRLLNFVDKTLVEDVLPILQVAFHSELTPVLEKCIRRI |
| GRMZM2G076450_T01 | (866) | SAVELMYAACTFKIPELTSLFQRRLLNFVDKTLVEDVIPILEVASHSGLTQVIDKCIQRI |
| Si000647m | (868) | FAVELMYAAWTFKIPELISLFQRRLLNFVDKTLVEDVIPILQVASHSELTQVLDKCIQRI |
| Si000671m | (870) | FAVELMYAAWTFKIPELISLFQRRLLNFVDKTLVEDVIPILQVASHSELTQVLDKCIQRI |
| Solyc07g044980.2.1 | (872) | YAVELMYASSTFQIKELVMFVERYLDNFVDKATPEDVIPILLVAFHRKSNQLLEHCIQRV |
| Eucgr.A02033.1 | (900) | YAVELMYASATFEIAELVMLVQRRLLHFIGKAAVEDVIPILKVAFNFRLKELLPSCFETV |
| Eucgr.A02033.2 | (902) | YAVELMYASATFEIAELVMLVQRRLLHFIGKAAVEDVIPILKVAFNFRLKELLPSCFETV |
| AT5G45110.1 | (864) | FVVQLMYASSVLQVPELVSSFQRRLCNFVENVLPILMVAFNCKLTQLLDQCIERV |
| Solyc02g069310.2.1 | (910) | FHVELMYASFVFQVPELVSLFRHLFSFVGKALVEDVIPILGVAFHCQMSELLTHCVDRV |
| Eucgr.E01922.1 | (916) | FAVELMYASYIFQIRELVSLLQRHLVNFVGKARSEDIIPILTVAFHCELNQLEMQCVDRV |
| Glyma09g02430.1 | (918) | FAVELMYASSIFQIPELVSLFQRRLLNFIGKALVEDVIPILTVAFHCQSNQLVNQCIDRV |
| Glyma15g13320.1 | (922) | FAVELMYASSIFQIPEFVSLFQRRLLNFIGKALVEDVIPILTVAFHCQLSQLVNQCIDRV |
| POPTR_0015s15800.1 | (908) | FAVELMYASSIFQVPELVSLFQRRLQNFVGKALVEDMIPILVVAFHCQLSQLVTQCVDRI |
| POPTR_0012s11900.1 | (920) | FAVELTYASSIFQVPELVSLFQRRLLNFVGKALVEDVIPILVVAFHCQSSQLIAQCVDRI |
| Glyma14g03510..1 | (896) | HALELMYASATFQMKELVLLFQRHLLNFVEKALVEDVIPILMAAFNCQLDQLLSRCIQRI |
| Glyma02g45260.1 | (894) | YALELMYASATFQMKELVLLFQRHLLNFVEKALVEDVIPILMAAFNCQLDQLLSQCIRRV |
| Glyma02g45260.2 | (898) | YALELMYASATFQMKELVLLFQRHLLNFVEKALVEDVIPILMAAFNCQLDQLLSQCIRRV |
| POPTR_0005s22770.1 | (906) | YAVELMYASATFQMKELVLLFQRRLLSFIDKALDEDVIPIVMAAFHCQLDQLLSLCIERL |
| clementine0.9_005201m | (890) | YVIELMYASAALQMKKLVIRLELWLINLVEKALVEDVIPILVAALHCQLNHLRSFCIQRI |
| clementine0.9_005587m | (892) | YAIELMYASAAFQMKELVLLFQRRLLNFVEKALVEDVIPILVAAFHCQLNQLRSHCVQRV |
| Consensus | (982,984) | xxXXxxxAXxxxXxxxXxxxxxLxxXX XxxXXXXPXXxxA |

BTB Domain →

FIG. 18E

```
Bradi1g12870.1         (878)  ADSSVDRHYLEKELPGEAFSRVKEIRRYSLHD-ETDESTLDPEHAKRVRN IHKALDSDDV
LOC_Os03g46440.1       (884)  ANSNLDNRYLEKRLPDDLYAKLKEFRVP----DEPHSGILDPEHEKRVRN IHKALDSDDV
LOC_Os03g46440.2       (886)  ANSNLDNRYLEKRLPDDLYAKLKEFRVP----DEPHSGILDPEHEKRVRN IHKALDSDDV
LOC_Os03g46440.3       (880)  ANSNLDNRYLEKELPDDLYAKLKEFRVP----DEPHSGILDPEHEKRVRN IHKALDSDDV
Si034834m              (882)  AVSSLDSRYLEKELPDDIYCKIKEIRQSVFHD-ESENAILDPEHEKRVRN ILKALDSDDV
GRMZM2G115162_T01      (888)  AVSALDSRYLDKELPADIYNKIKEIRRQ-----PENAILDPEHDKRVRN ILKALDSDDV
Bradi2g51030.1         (874)  VRSDLDNISLDKEVCPEVADKIKKIRQKSPPD-DGDTVILDPVHEKRVRF IHRALDSDDV
LOC_Os01g56200.1       (876)  ARSNLDNVSLDKELPPEVAVQIKEIRQKSQPN-EGDTVISDPVHEKRVRF IHRALDSDDV
GRMZM2G076450_T01      (866)  ARSDLDDISLDKELPPEAVDEIKNLRKK-SQTADGDTFISDPVHEKRVRF IHRALDSDDV
Si000647m              (868)  ARSNLDDISLDKELSPEVVEEIKKIRKK-LQTADDDASISDPVHEKRVRF IHRALDSDDV
Si000671m              (870)  ARSNLDDISLDKELSPEVVEEIKKIRKK-LQTADDDASISDPVHEKRVRF IHRALDSDDV
Solyc07g044980.2.1     (872)  ARSDLDNATLEKELPHEVLTDIKSRRLKSRQGTEQES--LDSLSEKRIRF ILKALESDDI
Eucgr.A02033.1         (900)  ARSYMDSIVLEKELPHEIYAEIKVQRDRFGEAGEPMVTEVNPSLEKSIKQ IHKALDNDDV
Eucgr.A02033.2         (902)  ARSYMDSIVLEKELPHEIYAEIKVQRDRFGEAGEPMVTEVNPSLEKSIKQ IHKALDNDDV
AT5G45110.1            (864)  ARSDLYRFCIEKEVPPEVAEKIKQLRLISPQDEETSPKISEKLLE-RIGK ILKALDSDDV
Solyc02g069310.2.1     (910)  ARSDLESTCIEKEVPFKVAESIKLSRLK-CQGDESMVLTVDPLHEKRKNF IYKALDSDDV
Eucgr.E01922.1         (916)  ARSDLDNIALEKELPPKVAEEIKLLRLKFQPKDETNLEIPDPLREKRIKF IHKALDSDDI
Glyma09g02430.1        (918)  ARSDLDQISIDQELPHELSQKVLLRRKPQQDVENDASVVDALSLKRITRI IHKALDSDDV
Glyma15g13320.1        (922)  ARSDLDQISIDQELPNELSQKVLLRRNPQRDVENDASIVDALSLKRITRI IHKALDSDDV
POPTR_0015s15800.1     (908)  ARSDLDNISIEKELPHDVAVEIKLLRRKSISDEENNTEAVDALREKRIKF IHKALDSDDV
POPTR_0012s11900.1     (920)  AVSNLDNISIEKELPHEVADKIKQLRRKPISDDENNTEAGDPLREKRIKF IHMALDSDDV
Glyma14g03510..1       (896)  ARSDFDNTSLEKELPHEVLTEIKSLRLSFQPESTPNAMEAESLNEKSIRF IHKAESDDV
Glyma02g45260.1        (894)  ARSDFDNTSLEKELPREVTEIKLLLRLPFQPESTPNAMEVESLNEKSIRF IHKALDSDDV
Glyma02g45260.2        (898)  ARSDFDNTSLEKELPREVVTEIKLLRLPFQPESTPNAMEVESLNEKSIRF IHKALDSDDV
POPTR_0005s22770.1     (906)  VRSDLDSVCIDKELPHEISSKVKILRKKSLEEAESSVEEVDPMREKRMSF IHKALESDDV
clementine0.9_005201m  (890)  AKSNLDNVCLEKELPDEVSSEIKSLRVKSNQESEANIAEVDPMHAKIVRF IHKALDSDDV
clementine0.9_005587m  (892)  VRSNLDDVCLEKELPDEVSGEIKSLRVKSDEECEANIAEVDPMHAKRVRF IHKALDSDDV
Consensus       (985,983)     SxXxxxxxXXXX                                      IxxALXxDDX
                                                                                ↑ANK Domain
```

FIG. 18F

| | | |
|---|---|---|
| Bradi1g12870.1 | (878) | ALVGMLLKESAITLDDAHAHYAAAYCEPKVLAGMLNLDS-ANVNLKNDSGYTPLHIACM |
| LOC_Os03g46440.1 | (884) | DLVGMLLKESPVTLDDAFAIHYAAAYCEPKVLAELLKLES-ANVNLKNSSGYTPLHMACM |
| LOC_Os03g46440.2 | (886) | DLVGMLLKESPVTLDDAFAIHYAAAYCEPKVLAELLKLES-ANVNLKNSSGYTPLHMACM |
| LOC_Os03g46440.3 | (880) | DLVGLLLKESAVTLDDAFAVHYAAAYCEPKVFAELLKLNS-ANVNLKNSGYTPLHIACM |
| Si034834m | (882) | DLVGLLLKESTVTLDDAFAIHYAAAYCEPKVFAELLKLDS-ANVNLKNSGGYTPLHIACM |
| GRMZM2G115162_T01 | (888) | ELVKLLLNESEITLDDANALHYAAAYCDSKVVSELLDLGL-ANLNLKNNRGYTALHLAAM |
| Bradi2g51030.1 | (874) | ELVKLLLNESEITLDDANALHYAAAYCDSKVVSELLDLRL-ANLNLKNSRGYTALHLAAM |
| LOC_Os01g56200.1 | (876) | ELVKLLLNESDITLDDANALHYAASYCDPKVVSELLDLAM-ANLNLKNSRGYTALHLAAM |
| GRMZM2G076450_T01 | (866) | ELVKLLLNESDITLDDANALHYAASYCDSKVVSELLELGL-ANLNLKNSRGYTALHLAAM |
| Si000647m | (868) | ELVKLLLNESEITLDDANALHYAASYCDSKVVSELLELGL-ANLNLKNSRGYTALHLAAM |
| Si000671m | (870) | ELVKLLLNESEITLDDANALHYAASYCDSKVVSELLELGL-ANLNLKNSRGYTALHLAAM |
| Solyc07g044980.2.1 | (872) | ELTLLLEESNVTLNDACALHYAAAYCNSKVVNEVLELGLGADVNLQNSRGYNVLHVAAR |
| Eucgr.A02033.1 | (900) | ELVRRLLNESVVTLDDAYALHYATAYCHPKIFKEVLGLGL-ADLNLKDSRGYTVLHVAAR |
| Eucgr.A02033.2 | (902) | ELVRRLLNESVVTLDDAYALHYATAYCHPKIFKEVLGLGL-ADLNLKDSRGYTVLHVAAR |
| AT5G45110.1 | (864) | ELVKLLLTESDITLDQANGLHYSVVYSDPKVVAEILALDM-GDVNYRNSRGYTVLHFAAM |
| Solyc02g069310.2.1 | (910) | ELVKLLLNESDISLDGAYALHYAVAYCDPKVVAEVLGLGV-ANVNLRNARGYTVLHIAAM |
| Eucgr.E01922.1 | (916) | ELVTLLLSESNINLDEAYGLHYAAAYCDPKVVSELLGLGL-ANVNLRNPRGYTVLHVAAM |
| Glyma09g02430.1 | (918) | ELVKLLLNESDITLDEANALHYAAAYCDPKVVSEVLGLGL-ANVNLRNSRGYTVLHIAAM |
| Glyma15g13320.1 | (922) | ELVKLLLNESDITLDEANALHYAAAYCDLKVVSEVLGLGL-ANVNLRNSRGYTVLHIAAM |
| POPTR_0015s15800.1 | (908) | ELVKLLLNESDITLDDANALHYCASYCDLKVMSEVLSLGL-ADVNLRNSRGYTVLHIAAM |
| POPTR_0012s11900.1 | (920) | ELVKLLLTESDISLDDANALHYCASYCDLKVMSEVLSLGL-ANVNLRNSRGYTVLHIAAM |
| Glyma14g03510..1 | (896) | ELLKLLLNESSVTLDDAYALHYACAYSDSKVIQEVLSLGM-ADILRRNSRGYTVLHVAAR |
| Glyma02g45260.1 | (894) | ELLKLLLNESSVTLDDAHALHYACAYSDSKVIQEVLSLGM-ADILRRNSRGYTVLHVAAR |
| Glyma02g45260.2 | (898) | ELLKLLLNESSVTLDDANALHYAAAYCAYSDSKVIQEVLSLGM-ADILRRNSRGYTVLHVAAR |
| POPTR_0005s22770.1 | (906) | ELVQILLSESNFTLDDAYALHYAVSVCDPKVVKEVLALGL-ADLNLRNSRGYTVLHVAAR |
| clementine0.9_005201m | (890) | ELLKLLLDVSNVTLDDAYALHYAAAYCSPKVFKEVLNMDL-ACLNLKDARGRTVLHVAAR |
| clementine0.9_005587m | (892) | ELLKLLLDESNVTLDDAYALHYAAAYCNPKVFKEVLNMGL-ADLNLKNARGHTVLHVAAR |
| Consensus | (983) | xLxxxLLxxSxxxLxxAxxxHYxxxYxxxKxxxxLxXxxxXxxXxxxGxxxLHxAxx |

———————— ANK Domain ————————

FIG. 18G

```
Bradi1g12870.1        (878) RREPDIIVSLIEKGASVLERT........RDGRDALTICKRLTREKDCRKKLEKCKERSKAYLCIDIL
LOC_Os03g46440.1      (884) RREPDIIVSLIEKGASVLERTQDGRDALTICKRLTREKDRNEKSEKCKERSKAYLCIGVL
LOC_Os03g46440.2      (886) RREPDIIVSLIEKGASVLERTQDGRDALTICKRLTREKDRNEKSEKCKERSKAYLCIGVL
LOC_Os03g46440.3      (880) RREPDIIVSLIEKGASVLERTQDGRDALTICKRLTREKDRNEKSEKCKERSKAYLCIGVL
Si034834m             (882) RREPDIILSLVERGASVMERTPDGRDAFTICKRLTREKDCNRKLEKCEEKSKAYLCIDIL
GRMZM2G115162_T01     (888) RREPDIILSLVERGACVLERTLDGRDALTICKRLTREKDCNRKLDKYEEKSKAYLCIDIL
Bradi2g51030.1        (874) RREPTIIMCLLNKGAVASQLTCDGRLASSICRRLTRAKDYNTKMEQGQESNKDKMCIDML
LOC_Os01g56200.1      (876) RREPAIIMCLLNKGAAVSQLTADGQSAMSICRRLTRMKDYNTKMEQGQESNKDRLCIDIL
GRMZM2G076450_T01     (866) RREPAIIMCLLNKGANVSQLTADGRSAIGICRRLTRAKDYNTKMEQGQESNKDRLCIDIL
Si000647m             (868) RREPAIIMCLLNKGATVSQLTADGRSAIGICRRLTRAKDYNTKMEQGQESNKDRLCIDIL
Si000671m             (870) RREPAIIMCLLNKGATVSQLTADGRSAIGICRRLTRAKDYNTKMEQGQESNKDRLCIDIL
Solyc07g044980.2.1    (872) RKEPSIIMGLLAKGASVLDTTRDGHTALSICRRLTRLKDYNDPPKQGKVTNKDRLCIDVL
Eucgr.A02033.1        (900) RKAPSILLPLLYKGACAMESTSDGQTAVTICRRSTRPKDYFQETKQGQESNKDRICIDAL
Eucgr.A02033.2        (902) RKAPSILLPLLYKGACAMESTSDGQTAVTICRRSTRPKDYFQETKQGQESNKDRICIDAL
AT5G45110.1           (864) RREPSIIISLIDKGANASEFTSDGRSAVNLRRLTNPKDYHTKTAKGRESSKARLCIDIL
Solyc02g069310.2.1    (910) RKEPSIIVSLLTKGAHASEITLDGQSAVSLCRRLTRPKEYHAKTEQGQEANKDRVCIDVL
Eucgr.E01922.1        (916) RKETKIIVSLLSKGACASELTPDGQNAVSICRRLTRPKDYNAKTEQCQEANKDRLCIDVL
Glyma09g02430.1       (918) RKEPSIIVSLLTKGACASDLIFDGQSAVSICRRLTRPKDYHAKTEQGKETNKDRICIDVL
Glyma15g13320.1       (922) RKEPSIIVSLLTKGACASDLIFDGQSAVSICRRLTRPKDYHAKTEQGKETNKDRICIDVL
POPTR_0015s15800.1    (908) RKEPSVIVSMLAKGASALDLISDGQSAVSICRRLTRPKDYHAKTEQGQEANKDRLCIDIL
POPTR_0012s11900.1    (920) RKEPSVIVSLLAKGASALDLTSDGQSAVSICRRLTRPKDYHAKTEQGQEANKDRLCIDIL
Glyma14g03510..1      (896) RKDPSILVALLNKGARASDTTPDGQTALAICQRLTRCKDYHEKTVQCKESNKDRLCVDVL
Glyma02g45260.1       (894) RKDPSILVALLNKGACASDTTPDGQTALAICQRLTRYKDYQEQTVQCKESNKDRLCVDVL
Glyma02g45260.2       (898) RKDPSILVALLNKGACASDTTPDGQTALAICQRLTRYKDYQEQTVQCKESNKDRLCVDVL
POPTR_0005s22770.1    (906) RKESSILVALLAKGARASEIIMDGRNAVSIWRSLTRPKDYNANTKQGQESNKDRICIEIL
clementine0.9_005201m (890) RNEPEVMVTLLSKGACAMETTSDGQTAVAICRRMTRLKDYLEATKQGQTNKDRLCIDVL
clementine0.9_005587m (892) RKEPAVLVTLLSKGACASETTSDGQTAVAICRRMTRRKDYIEATKQGQETNKDRLCIDVL
Consensus          (983,986) RxxxxXXXxXxxxxGAxxxX                                  KxxxCXxxL
                              ←─────── ANK Domain ───────→
```

FIG. 18H

```
Bradi1g12870.1         (878)  EQVIKTKSSISEE-RLCEEVQIATPLLADNFHMRLLNLENRVSFARIFFPSEAKLVMRIA
LOC_Os03g46440.1       (884)  QQEIKRRPQILED-QMSAEESIATPLLVDNFHMRLLNLENRVAFARIFFPSEAKLVMRIA
LOC_Os03g46440.2       (886)  QQEIKRRPQILED-QMSAEESIATPLLVDNFHMRLLNLENRVAFARIFFPSEAKLVMRIA
LOC_Os03g46440.3       (880)  QQEIKRRPQILED-QMSAEESIATPLLVDNFHMRLINLENRVAFARIFFPSEAKLVMRIA
Si034834m              (882)  EQELKRKSFILD--QISIEESIATPLLVDNFHMRLINLENRVAFARIFFPSEAKLVMRIA
GRMZM2G115162_T01      (888)  EQELKRKSFVLDPISISIEESIATPLLVDNFHMRLINLENRVAFARLFFPAEAKVAMQIA
Bradi2g51030.1         (874)  EREM-RRN------PMPVEDSVTSPLLADDLHMKLNYLEIRVAFARLFFPAEAKVAMQIA
LOC_Os01g56200.1       (876)  DREMIRK-------PMAVEDSVTSPLLADDLHMKLLYLENRVAFARLFFPAEAKVAMQIA
GRMZM2G076450_T01      (866)  EREM-MRN------PMAVEDAVTSPLLADDLHMKLLYLENRVAFARLFFPAEAKVAMQIA
Si000647m              (868)  EREM-MRN------PMSVEDAVTSPLLADDLHMKLLYLENRVALAILFFPAEAKVAMQIA
Si000671m              (870)  EREM-MRN------PMSVEDAVTSPLLADDLHMKLLYLENRVALAILFFPAEAKVAMQIA
Solyc07g044980.2.1     (872)  EREM-IRN------PMIGSMCSSSLVLADELLMRLLFENRVALARMLFPQEAMLAMEIA
Eucgr.A02033.1         (900)  EREMQRRI------SEAGYMSISPDAITDDIY-RLDYLVGRVKFAAMFFPAEAKIAMEIA
Eucgr.A02033.2         (902)  EREMQRRI------SEAGYMSISPDAITDDIY-RLDYLVGR-------------------
AT5G45110.1            (864)  EREI-RKN------PMVLDTPMCSISMPEDLQMRLLYLEKRVGLAQLFFPTEAKVAMDIG
Solyc02g069310.2.1     (910)  EREM-RRN------PMTGDALFSSPMLADDLPMKLLYLENRVAFARLLFPLEAKLAMEIA
Eucgr.E01922.1         (916)  EREL-WRN------PLAGDASVSYPIVSDDLHMKLLYLENRVAFARLFFPTEAKLAMDIA
Glyma09g02430.1        (918)  EREM-RRN------PMAGDACMSSHTMADDLHMKLLYLENRVAFARLFFPSEAKLAMDIA
Glyma15g13320.1        (922)  EREM-WRN------PLAGDACMSSHTMADDLHMKLLYLENRVAFARLFFPSEAKLAMDIA
POPTR_0015s15800.1     (908)  EREM-RRN------PMAGSASITSHTMVDDLHMKLLYLENRVAFARLFFPTEAKLAMDIA
POPTR_0012s11900.1     (920)  EREM-RRN------PRGGSASITSHTMVDDLHMKLLYLENRVAFARLFFPTEAKLAMDIA
Glyma14g03510..1       (896)  EREM-RRN------SMTVNMSVSSQLTADDLHMRLDYLEDRVAFARLFFPAEARVAIENA
Glyma02g45260.1        (894)  EREM-RRN------SMTVNMSVSSQLTANDLHMRLDYLEDRVAFARLFFPAEARVAIENA
Glyma02g45260.2        (898)  EREM-RRN------SMTVNMSVSSQLTANDLHMRLDYLEDRVAFARLFFPAEARVAIENA
POPTR_0005s22770.1     (906)  ETEM-RRT------SMSANISMISP-----DLNMKPDDLEDRVAFARLFFPAEARLAKDMA
clementine0.9_005201m  (890)  EREM-RRN------SMSENLAMPSEVMDDDFQAKLDYLENTVAFVRL-FPSEARVAMEIA
clementine0.9_005587m  (892)  EREM-RRN------SMSGNLALSSEVMADDFQMKLNYLENRVAFARLLFPSEARVAMHIA
Consensus              (986)  xxxXXxx
```

FIG. 18I

```
Bradi1g12870.1        (878)  QADSTEEFTGL------TLANFAKLKD-DLNDL-----KLRERFDALTKT-------
LOC_Os03g46440.1      (884)  QADSTQEFAGL------TSANFSKLKEVDLNETPTMQNRRLRERLDALTKT------
LOC_Os03g46440.2      (886)  QADSTQEFAGL------TSANFSKLKEVDLNETPTMQNRRLRERLDALTKT------
LOC_Os03g46440.3      (880)  QADSTQEFAGL------TSANFSKLKEVDLNETPTMQNRRLRERLDALTKT------
Si034834m             (882)  QADSTEEFAGI------RNFSKLKEVDLNETPTMQNRRLRERLDALTKT--------
GRMZM2G115162_T01     (888)  QADSTQEFAGI------TNFSRLKEVDLNETPTMQNRRLRERLDALTKT--------
Bradi2g51030.1        (874)  QADITPEVTGVS-----AASTSGKLKEVDLNETPVTQNKRLRSRVDALVKT------
LOC_Os01g56200.1      (876)  QADTTPEFGIVP-----AASTSGKLKEVDLNETPVTQNKRLRSRVDALMKT------
GRMZM2G076450_T01     (866)  QADTTEEFGGIVAV---AASTSGKLREVDLNETPVTQNKRLRSRVDALMKT------
Si000647m             (868)  QADTTEEFGGITAPGTTAPGTTAPSTSGKLREVDLNETPAIQNKRLRSRVDALMKTVLTHIIWHY
Si000671m             (870)  QADTTEEFGGITAPGTTAPGTTAPSTSGKLREVDLNETPAIQNKRLRSRVDALMKT-
Solyc07g044980.2.1    (872)  HADSTAEFTGLSA----TNGLCKNPGGVDLNKLPSEQVKRLQDRLGALLKT-------
Eucgr.A02033.1        (900)  DAEWTSLYKGLA-----SKSLNVDFKEVDLNEGPAF----LANGLQALRKT-------
Eucgr.A02033.2        (902)  -----------------GKPK-------CRIVCYVFSLVDL----------------
AT5G45110.1           (864)  NVEGTSEFTGLSPP---SSGLTGNLSQVDLNETPHMQTQRLLTRMVALMKT-------
Solyc02g069310.2.1    (910)  TAETTAEFADHLA----SKASSGILREVDLNETPIMQKER------LSKT-------
Eucgr.E01922.1        (916)  HAEMTAEFAGLSA----RKGSSGNLREVDLNETPIDQNKRLRSRMEALQRT------
Glyma09g02430.1       (918)  HAETTSEFAGLSAS---NSKGSGNGNLREVDLNETPIVQNKRLLSRMEALTKT-----
Glyma15g13320.1       (922)  HAETTSEFAGLSAS---NSKGSGNGNLREVDLNETPIVQSKRLFSRMEALMKT-----
POPTR_0015s15800.1    (908)  HAATTPEFAGLAA----SKGSNGNLREVDLNETPIMQNKRLRSRMEALMKT-------
POPTR_0012s11900.1    (920)  HAATTSEFAGLAA----SKGSSGNLREVDLNETPIMQNKRLRSRMEALMKT-------
Glyma14g03510..1      (896)  EADSSSLYANSSA----LKVTNGNPKEVDLNESPSARTRKLQLRLHALMKT-------
Glyma02g45260.1       (894)  EADSSSMYANSSA----LKGTNGNLKQVDLNESPSAHTRKLQLRLHALMKT-------
Glyma02g45260.2       (898)  EADSSSMYANSSA----LKGTNGNLKQVDLNESPSAHTRKLQLRLHALMKT-------
POPTR_0005s22770.1    (906)  NADSTSMYTGLPAS---KSKGSSGDTREVDLNETPSVQDKRLQLRLQELRKT------
clementine0.9_005201m (890)  GADTATGLSALG-----QKGLSGNLKEIDLNETPSMQAKSRQLRLTLLKT--------
clementine0.9_005587m (892)  DADATNFYTGLSAS---KSKGSSGNLKEVDLNETPSMQAKRLQLRLQALLKT------
```

FIG. 18J

```
Bradi1g12870.1           (878) -VELGRGYF------PHCSEVLD----KFLNEE-ST---ELFFLETGTPE
LOC_Os03g46440.1         (884) -VELGRRYF------PHCSEVLD----KFLNEE-ST---DLILLESGTAE
LOC_Os03g46440.2         (886) -VELGRRYF------PHCSEVLD----KFLNEE-ST---DLILLESGTAE
LOC_Os03g46440.3         (880) -VELGRRYF------PHCSEVLD----KFLNEE-ST---DLILLESGTAE
Si034834m                (882) -VELGRRYF------PHCSDVLD----KFLIEE-ST---DLIYLETGTPE
GRMZM2G115162_T01        (888) -VELGRRYF------PHCSDVLD----KFLNEE-ST---DPIFLETGTPE
Bradi2g51030.1           (874) -VELGRRYF------PSCSEVLD----KYLEDD-LPDGLDIFHQQSGTPD
LOC_Os01g56200.1         (876) -VELGRRYF------PNCSQVLD----KFLEDD-LPDSPDALDLQNGTSD
GRMZM2G076450_T01        (866) -VELGRRYF------PNCSQVLD----KFLEDD-LPEGLDQFYLQRGTAD
Si000647m                (868) AVELGRRYF------PNCSQVLDKYLEYKYLEYD-LPDGLDQFYLQRGTPD
Si000671m                (870) -VELGRRYF------PNCSQVLDKYLEYKYLEYD-LPDGLDQFYLQRGTPD
Solyc07g044980.2.1       (872) -VDTGRRFF------PNCSEVLD----RLLEDD-KL---DSLMLESGTPE
Eucgr.A02033.1           (900) -VEMGRRYF------PHCSEVLD----KFL-DE-AP---DDFFLDQGTSE
Eucgr.A02033.2           (902) -YFFGKICF-------PFL--------DV------E
AT5G45110.1              (864) -VETGRRFF------PYGSEVLDKYMA-EYIDDD-IL---DDFHFEKGSTH
Solyc02g069310.2.1       (910) -VELGKCYF------PHCSEVLD----KFMEDD-LP---DLFFLEKGTPE
Eucgr.E01922.1           (916) -VEMGRRYF------PNCSEVLD----KFMEDD-LP---DLCYLEKGTPD
Glyma09g02430.1          (918) -VEMGRRYF------PHCSEVLD----KFMEDD-LP---DLFYLEKGTHE
Glyma15g13320.1          (922) -VEMGRRYF------PHCSEVLD----KFMEDD-LP---DLFYLEKGTNE
POPTR_0015s15800.1       (908) -VEMGRRYF------PSCSEVLD----KFMEDD-LP---DLFYLEKGTPD
POPTR_0012s11900.1       (920) -VEMGRRYF------PNCSEVLD----KFMEDD-LP---DLFFLEKGTPD
Glyma14g03510..1         (896) -VENGRRFF------PHCSEVLD----KFLEDDEMP---DVFFLEKGSEE
Glyma02g45260.1          (894) -VENGRRFF------PHCSEVLD----KFLEDDDMP---DVFFLEKGSED
Glyma02g45260.2          (898) -------------GMSKTILK
POPTR_0005s22770.1       (906) -VEMGRLYF------PHCSEVLD----KFLDDD-VP---DALYLDKGTPA
clementine0.9_005201m    (890) -VETGHLYFPHCSEVVVKFIDCYSPHCSEVVD----EFLDCD-WS---DASLLEKGTPE
clementine0.9_005587m    (892) -VETGRRYF------PHCSDVVD----KFLDCD-WS---DASLLENGTPE
```

FIG. 18K

| | | |
|---|---|---|
| Bradi1g12870.1 | (878) | DQRIKRMRFSELKEDVLKAFSKDK-AVAAIASSTSSSSSPRYDGKVRHGNKRAKLLR |
| LOC_Os03g46440.1 | (884) | DQQTKRMRFSELREDVRKAFTKDKAAGAAISSSTSASSSPRYETKLRPGNKKGKLSR |
| LOC_Os03g46440.2 | (886) | DQQTKRMRFSELREDVRKAFTKDKAAGAAISSSTSASSSPRRERRGRSRRA------ |
| LOC_Os03g46440.3 | (880) | DQQTKRMRFSELREDVRKAFTKDKAAGAAISSSTSASSSPS---------------- |
| Si034834m | (882) | DQHLKRMRFSELREDVRKAFTKDKAAVTAIASSASSSSSSRYEGRGRQSNRKSKQSR |
| GRMZM2G115162_T01 | (888) | DQQVKRMRFSELREDVRKAFTKDKAAVAAIASSASSSSSPRCRRPNRKSR------- |
| Bradi2g51030.1 | (874) | EQKVKKMRFCEVKEDVRKAFSKDTADKSAFSALSNSSSSPPPPQKIAQK-------- |
| LOC_Os01g56200.1 | (876) | EQNVKRMRFCELKEDVRKAFSKDR-ADNSMFSILS--SSSSSPPPKVAKK------- |
| GRMZM2G076450_T01 | (866) | EQKVKRMRFCELKEDVLKAFSKDK-AEGSVFSGLS--SSSSCSPPQKYAQR------ |
| Si000647m | (868) | EQKVKRMRFCELKEDVRKAFTKDK-ADNSMFSGLS--SSSSCSPPQKIAKK------ |
| Si000671m | (870) | EQKVKRMRFCELKEDVRKAFTKDK-ADNSMFSGLS--SSSSCSPPQKIAKK------ |
| Solyc07g044980.2.1 | (872) | EQRSKKMRYTELKDEVMEAFKKDK-AEKNWAGFST--SSSSSCSPKTNVSHKNRKK- |
| Eucgr.A02033.1 | (900) | EKTSKKMRFMELKEEFQKAISKDM-AENKKSGRFPA-SSSSCSPRQRMKKK------ |
| Eucgr.A02033.2 | (902) | EPHLMRVNIRCIR--CAHNFMKE----------------------SSSSSIRDDLHNTT---- |
| AT5G45110.1 | (864) | ERRLKRMRYRELKDDVQKAYSKDKESKIARSCLSASSSPSSSSIRDDLHNTT----- |
| Solyc02g069310.2.1 | (910) | EQIKRRFKELKDDVQRAFNKDK-AGLHRSGSSS--SSSSTTFNDGASV-KARNL |
| Eucgr.E01922.1 | (916) | EQRIKTRRFMELKDDVQKAFSKDK-AEMSRSGISS--SSSSSSLK---YNNKIRRS |
| Glyma09g02430.1 | (918) | EQRIKRTRFMELKDDVHKAFNKDK-AEFSRSGISS--SSSSSSLRDSVVHYKARKV- |
| Glyma15g13320.1 | (922) | EQRIKRTRFMELKDDVHKAFNMDK-AEFSRSGISS--SSSSSSLRDSVVHYKARKV- |
| POPTR_0015s15800.1 | (908) | EQRIKRTRFMELKDDVHRAFTKDK-AEINRTGLSS--SSSSSLKDGISNKLRKL--- |
| POPTR_0012s11900.1 | (920) | EQRIKRTRFMELKDDVQKAFNKDK-AVINRSVLSS--SSSSSQKDCVGNKLRKL--- |
| Glyma14g03510..1 | (896) | EQRIKKARFMELKDDVQKAFHKDM-AENNHSGFSSTVSSSSSSTRREGLNHRVRRK- |
| Glyma02g45260.1 | (894) | EQRIKKARFMELKDDVQKAFHKDM-AENNHSGFSSTVSSSSSSTRREGLNHRVRRK- |
| Glyma02g45260.2 | (898) | -------------------------------------------------------- |
| POPTR_0005s22770.1 | (906) | EQKTKRMRFLELKEDVQMAFNKDM--EKNRSVLSS--SSSFSSSSPKSGVTRKARRKC |
| clementine0.9_005201m | (890) | EQILRRAYFMKLKEDMQEALCKDV-AYHRHSGLPS-----SCGTRKR---------- |
| clementine0.9_005587m | (892) | EQRLKRARFMELKEDVQKAFYKDM-AEKNRSGLSS--SSSSSSPKEGVKCKGRKR-- |

FIG. 18L

FIG. 21A

```
AT4G09820.1           (1132) YNGAIKTRKTTQP--------------AEV-TAEEAAL----ERSQQLRELYETLLAGEST----
Glyma03g30940.1       (1134) YNGAIKTRKTVQA--------------MEV-STEEASL----QRSEQLRELYESLSGGETN----
Glyma19g33770.1       (1136) YNGAIKTRKTVQA--------------MEV-STEEASL----QRSEQLRELYESLSAEETNT---
Glyma10g03140.1       (1138) YNGAIKTRKTVQP--------------MEV-SAEEASL----QRSQQLRELYESLSAGETN----
Glyma02g16670.1       (1140) YNGAIKTRKTVQP--------------MEV-SAEEASL----QRSQQLRELYESLSVGETN----
GSVIVT01011123001     (1142) YNGAIKTRKTVQP--------------MEV-SAEEASL----QRSQQLRELYESLSAGETN----
Eucgr.H01487.1        (1144) YNGPIKTRKTVQP--------------MEV-SAEEASL----QRSQQLRELYESLSAGETN----
Eucgr.H01487.2        (1146) YNGPIKTRKTVQP--------------MEV-SAEEASL----QRSQQLRELYESLSAGETN----
Bradi1g54070.1        (1148) YNGAIKTRKTVQQA-------HGHGAPA-PADQAAR------HRSRQLKELFESLAREAAACGGP
GRMZM2G042733_T01     (1150) YNGAIRTRKTMTTVRQPAGAEDA-GDEETAL-----RRSRQLKELYDSLAAGEAAYDGG
Si029106m             (1150) YNGAIKTRKTTVA-----PGGGGEE-EEEEGTAARRRSRQLRELYDSLAAGAEADGGG
LOC_Os04g47080.1      (1022) YNGETKTRKTTNS-------------MNL-MADELVL-----QRSEQLRELYDSLLSGECG----
LOC_Os04g47040.1      (1020) YNGVVKTRKISNS-------------ADL-TAGQLVV-----QRSEQLRELYYSLLSGECD----
Si000845m             (1030) YNGEVKTRKIVNS-------------AEL-TADQLVM-----QRSEQLRELYEALLSGECD----
GRMZM5G822829_T03     (1028) YNGEVKTRKISNS-------------VEL-TSDHLVM-----QRSDQLRELYEALLSGEGDRR--
AT4G00480.1           (1016) YNGDMKKRKKSYE-----------------SHYKYGL-----QKSKELRKLYLSMLEGDSG----
AT1G63650.1           (1034) YNGDIKTRKTIQA-------------AEV-KIDQLGL-----ERSEQLRELYESLSLAESSASG-
AT5G41315.1           (1036) YNGDIKTRKTIQA-------------SEI-KADQLGL-----RRSEQLSELYESLSVAESSSSGV
Glyma03g01180.1       (1046) YNGDIKTRKTIQA-------------TELEIKADKIGL----QRSEQLKELYKFLLAGEADH---
Glyma07g07740.1       (1048) YNGDIKTRKTIQA-------------MELEMKADKIGL----QRSEQLKELYKFLLAGEAD----
Glyma05g37770.1       (1064) YNGDIKTRKTSQG-------------VEL-NSDQIGL-----QRSEQLRELFKSLKTVEVS----
Glyma08g01810.1       (1066) YNGDIKTRKTSQG-------------VEL-NSDQIGL-----QRSEQLRELFKSLKTVEVT----
POPTR_0002s16080.1    (1050) YNGDIKTRK-VQA-------------TEL-KADKIGL-----QRSEQLRELYKSLLGGDAG----
POPTR_0014s07960.1    (1052) YNGDIKTRK-VEA-------------MEL-KADKIGL-----QRSEQLRELYESLLEGETG----
clementine0.9_004500m (1038) YNGDIKTRKTMQA-------------MEL-TPDKIGL-----QRSKQLRELYESLLKGESE----
Eucgr.D02287.1        (1044) YNGDIKTRKTVQA-------------VEL-KPDKIGL-----QRSEQLRDLYESLLEGETD----
GSVIVT01026927001     (1054) YNGDIKTRKTVQE-------------MEL-KADKMGL-----QRSEQLRELYESLLEGETD----
Solyc08g081140.2.1    (1056) YNGDIKTRKTVQA-------------GEV-NEDQLGL-----HRTEQLKELYSSLLTSESEED--
Eucgr.D01841.1        (1060) YNGDIKTRKTIQA-------------VEL-NTDQIGM-----QRSEQLRELYESLSAGESS----
GSVIVT01019750001     (1058) YNGDIKTRKTVQA-------------VEF-NADQMGL-----QRSEQLRELYESLSIGESN----
POPTR_0001s09450.1    (1070) YNGDIKTRKTIQS-------------IEL-DEDELGL-----QRSEQLRELYESLSVGEAS----
POPTR_0003s12810.1    (1072) YNGDIKTRKTVQS-------------IEL-NADELGL-----QRSEQLRELYESLSAGEAN----
Consensus             (1153) YNGxxKxRKxxxx              xxxxxxxxxxxxxx  xxXxxXLxxxLXxxxXxxxXXXX
```

FIG. 21B

| Sequence | Position | Alignment |
|---|---|---|
| AT4G09820.1 | (1132) | ------------------SEARAC-TALSPEDLTETEWFYLMCVSFSFPPPSGMPGKAYA |
| Glyma03g30940.1 | (1134) | ----A-------------------KTRRPC-ASLSPEDLTETEWFYLLCVSFSFHPGLGLPGTAYA |
| Glyma19g33770.1 | (1136) | -------------------------QTRRPC-AALSPEDLTESEWFYLLCVSFSFHLGIGLPGTAYA |
| Glyma10g03140.1 | (1138) | ----P-------------------PCRRPC-AALSPEDLTESEWFYLMCVSFSFPPGVGLPGKAYA |
| Glyma02g16670.1 | (1140) | ----P-------------------PTRRPC-AALSPEDLTESEWFYLMCVSFSFPPGVGLPGKAYA |
| GSVIVT01011123001 | (1142) | ----Q-------------------PARRPC-AALSPEDLTESEWFYLMCVSFSFPPGVGLPGKAYA |
| Eucgr.H01487.1 | (1144) | ----Q-------------------PARRPC-AALSPEDLTETEWFYLMCVSFSFPPGAGLPGKAYA |
| Eucgr.H01487.2 | (1146) | ----Q-------------------PARRPC-AALSPEDLTETEWFYLMCVSFSFPPGAGLPGKAYA |
| Bradi1g54070.1 | (1148) | GGIMMMTGCRAEAAVQEA-SARRPT-AALAPEDLTETEWFYLMCASYSFPPHVGLPGRAFA |
| GRMZM2G042733_T01 | (1150) | GGVGDPQQQHQQQVAVVPPRRPV-AALAPEDLTETEWFYLMCASYCFPPAVGLPGEAFV |
| Si029106m | (1150) | GGGGGGSGSGREDGAV-VARRSS-AALAPEDLSETEWFYLMCGSYCFPPGLGLPGEAFA |
| LOC_Os04g47080.1 | (1022) | -----H-------------------RARRPV-AALLPEDLGDTEWYVVVCMTYAFGPRQGLPGKSFA |
| LOC_Os04g47040.1 | (1020) | -----H-------------------RARRPI-AALSPEDLADTEWYVVVCMTYSFQPGQGLPGKSYA |
| Si000845m | (1030) | -----R-------------------RAARPV-ASLSPEDLGDTELYVVCMTYAFRPGQGLPGRSFA |
| GRMZM5G822829_T03 | (1028) | -----A-------------------APARPA-GSLSPEDLGDTEWYVVSMTYAFRPGQGLPGRSFA |
| AT4G00480.1 | (1016) | ----TTVSTTHDNLNDDDNCHSTSMMLSPDDLSDEEWYYLVSMSYVFSPSQCLPGRASA |
| AT1G63650.1 | (1034) | ---SSQ-------------------VTRRASAAALSPEDLTDTEWYLVSMSFVFNIGEGIPGGALS |
| AT5G41315.1 | (1036) | -AAGSQ-------------------VTRRASAAALSPEDLADTEWYLVCMSFVFNIGEGMPGRTFA |
| Glyma03g01180.1 | (1046) | -----P-------------------QTKRPS-VALAPEDLSDLEWYLVCMSFVFNHNQSLPGRALE |
| Glyma07g07740.1 | (1048) | -----P-------------------QTKRPS-AALAPEDLSDLEWYLVCMSFVFNHNQSLPGRALE |
| Glyma05g37770.1 | (1064) | -----P-------------------QTKRPS-AALSPEDLTDAEWYLVCMSFIFNIGQGLPGRTLA |
| Glyma08g01810.1 | (1066) | -----P-------------------QTKRPS-AALSPEDLTDAEWYLVCMSFIFNIGQGLPGRTLA |
| POPTR_0002s16080.1 | (1050) | -----Q-------------------QAKRSS-PALSPEDLSDEEWYLVCMSFVFNPGEGLPGRALA |
| POPTR_0014s07960.1 | (1052) | -----L-------------------QATRSS-PALSPEDLTDEEWYLVCMSFVFNPGEGLPGRALA |
| clementine0.9_004500m | (1038) | -----L-------------------AYKRPS-AALSPEDLTDAEWYYLVCMSFVFSSGQGLPGRALA |
| Eucgr.D02287.1 | (1044) | -----A-------------------QNKRPS-AALSPEDLTDEEWYLVCMSFVFNPGEGLPGRALA |
| GSVIVT01026927001 | (1054) | -----Q-------------------QSKRPS-AALSPEDLSDAEWYLVCMSFVFNPGEGLPGRALA |
| Solyc08g081140.2.1 | (1056) | -LQP---------------------QAKRPS-ASLSPEDLTDTEWYFLVCMSFVFNVGQGLPGKTLA |
| Eucgr.D01841.1 | (1060) | -----P-------------------QVRRPS-AALSPEDLTDAEWYLVCMSFIYDIGQGLPGRTLI |
| GSVIVT01019750001 | (1058) | -----P-------------------QPRRHS-AALSPEDLTDAEWYLVCMSFVFDIGQGLPGRTLA |
| POPTR_0001s09450.1 | (1070) | -----P-------------------QARRPS-AALSPEDLTDTEWYLVCMSFIFDIGQGLPGTTLA |
| POPTR_0003s12810.1 | (1072) | -----P-------------------QARRPS-AALSPEDLTDTEWYLVCMSFVFDNGQGLPGTTLA |
| Consensus | (1153) | xxxxxxxxxxxxxxxxxxxxxxxxxxxxxxxLxPxDLxDxExYxxxxMxxxxxxxxxPGxxxx |

FIG. 21C

FIG. 21D

```
AT4G09820.1       (1132) TKSFFYDHCKTNPKPALSEHSTYEVHEEAED--------------EEEVEEEMTMS-----------------------
Glyma03g30940.1   (1134) IKSFFIDQQHPALTAKP---ALSEQYSTSKP----TSSSSYPLVTANNTIPI--------------------------
Glyma19g33770.1   (1136) IKSFFIDQQPPPTAKP---ALSEHSTSNL------TSSYPLVIPVTAAATANNVLIQ---------------------
Glyma10g03140.1   (1138) SFFSFLNTQPQTPPPL--------NTSP-------PSYKAGYGIARQTPTPAM------------------------
Glyma02g16670.1   (1140) VKTFFFIDHLIPLRPKPA------LSEHSTSNP------TSSDHIPTVMILK-------------------------
GSVIVT01011123001 (1142) VKSFFTDHQLHNHPPKP-------ALSEHSTSNP-----ATSSDHSQEEEEEE-----------------------
Eucgr.H01487.1    (1144) VKTFFVDHHPPHPPKPA-------LSEHSTSNP------AATSSGHHRFHSPPVPSYAPADPPAA------------
Eucgr.H01487.2    (1146) VKTFFVDHHPPHPPKPA-------LSEHSTSNP------AATSSGHHRFHSPPVPSYAPADPPAA------------
Bradi1g54070.1    (1148) AMSIFMDQQDIQMIPTI-------SEHSTSDK-------ICHMYQQSFQTPRKIHA--------------------
GRMZM2G042733_T01 (1150) VRNLFVDQHGAHIMPTT-------LSGYSTSTP------TTQLNHQPFQTK-------------------------
Si029106m         (1150) ARSIFMDQHGIPIMPTL-------SGHSTSTP-------STHINHQPSQIKIEKYIGGRNVRPN------------
LOC_Os04g47080.1  (1022) IAASFWDTPPRAAFSSEAGADADIVVFEDLDH-------GNAAVEATTTTVPGEP---------------------
LOC_Os04g47040.1  (1020) IVAVFQELQFPICLEVL-MSTSPSPNETEDA--------DIVSEGLITHNAIE----------------------
Si000845m         (1030) ATASFCEMQFPACSQEP-SSSPSANETGKP---------ADIIVFEDLDHIAM---------------------
GRMZM5G822829_T03 (1028) ATAAFWEPQCPTYSEEPSSSPSGRANETGEA--------AADDGTFAFEEL----------------------
AT4G00480.1       (1016) IKSCLMEIS---------AHQDNDDEKK-----------MEIKISEEK-----------------------
AT1G63650.1       (1034) VKTLFLEA--PPYTTIS---TRSDYQEIFDP--------LSDDKYTPVFITEAF------------------
AT5G41315.1       (1036) VKTSFLEAPDPYATILP-ARSDYHIDNVLDPQQILGDEIYAPMFSTEPFP---------------------
Glyma03g01180.1   (1046) VKACFLEISKPTCSDKS-SSILDKPHDDKYP--------TCTKGDQRVLDTMALE---------------
Glyma07g07740.1   (1048) VKACFLEISKPTCSDKS-SSVLDKPHDDKYP--------TCTKGDQRVLEAMALENPCSL----------
Glyma05g37770.1   (1064) IKTSFLNSLHVDVPNKS-VATLKSRKQEDL---------SYVAFDHNDYNVESIPEVG-----------
Glyma08g01810.1   (1066) IKTSFLNSLHANVPNKS-VATLKSRNQEDL---------SYAAFDHNDYNVKSIPEVG-----------
POPTR_0002s16080.1 (1050) IKASLLDFSKPDCSEKS-SSAAHNGDDDEDP-------MSTKISHEIVDSLVLENLYTPTDDIE------
POPTR_0014s07960.1 (1052) IKASLLDFSKPVCSDKS-FSAAHNKDDDKDP-------MSTRISHEIVDTLALENLYTPTEDIE------
clementine0.9_004500m (1038) IKASLLDFSKPFCSEKS-SSPPYDEDDDSDP-----LCAKVSHEILDTVALESLYSPGEENK------
Eucgr.D02287.1    (1044) IKVSLLDFSKPICSEKS-SSIPQNGDADKEP-------MCAKVDCGMVDELVLENLYSPAQEIK------
GSVIVT01026927001 (1054) IKACLLELSKPICSEKS-SFVPCNTDDDKDR-------MCAKVDHDIEGMSELH----------------
Solyc08g081140.2.1 (1056) IKNSFLEVDYSVILKRP-NYVSNDAKNDTNI------GSQKPDHNALENDAYP----------------
Eucgr.D01841.1    (1060) VKGTLLEIQYPIASKKF-SALIGDTIDQDD--------VDILDHDILDVKLVP----------------
GSVIVT01019750001 (1058) IKTSFLEIPYPMLSRIS-------NSRKIREDKDP---ASAELDHNFLDTNLNPAV-------------
POPTR_0001s09450.1 (1070) IKTSFLEIPYAVAAKNS-------SARSEKEL------ACATFNRETLDTKPIPVIG------------
POPTR_0003s12810.1 (1072) IKTSFLEIPYTVTANHS-------SAKSDKEL------ACATFNREIHDTKPVPVI-------------
```

FIG. 21E

```
AT4G09820.1              (1132) ------------------EEMRLGSPDD------------------------------
Glyma03g30940.1          (1134) -------QNIVDRGEAIILNNNTKEAELAV------PNSSF--------------IPSEL
Glyma19g33770.1          (1136) NDMNIVDKGEAIILNNNNNNTEAELLADPNSNS---------------F------IPSEL
Glyma10g03140.1          (1138) ------------------------------------------------------AAEPS
Glyma02g16670.1          (1140) -------RKRKRKKRTRPST----------------------------------VAEPS
GSVIVT01011123001        (1142) -------EEEEEEEEAESDSEAET------------------------------GRNNR
Eucgr.H01487.1           (1144) ANQGDEEEEDDDDDDEEGESDSEAETGR-----QGAAAAAQNPHGAG-------PANNA
Eucgr.H01487.2           (1146) ANQGDEEEEDDDDDDEEGESDSEAETGR-----QGAAAAAQNPHGAG-------PANNA
Bradi1g54070.1           (1148) GQDNEMEHDDDDIGAECASGSGTNTGRNYSRDAPLNIVGNTDDQATPNAGSS
GRMZM2G042733_T01        (1150) ----------------------------------TGISL--------------NLGDE
Si029106m                (1150) NLNPEEEHIETEDDNHMIDSETNTENDSCRHLP-------LGNVGNGQAGPNARSSD
LOC_Os04g47080.1         (1022) -------------HAVAGGEVAECEPN---------G---------------SDNDL
LOC_Os04g47040.1         (1020) ------EGQMVVSDECVSNANRDP------------------------------ITMEI
Si000845m                (1030) ------------------------------------------------------EAMIA
GRMZM5G822829_T03        (1028) -------DHNNGMDIEA------------MTAAG-------------------GHGQE
AT4G00480.1              (1016) ---------------------------------------------------------
AT1G63650.1              (1034) ------PTTSTSGFEQEP-----EDHDSFIND---G--------------GASQV
AT5G41315.1              (1036) -------TASPSRTTNGFDQEHEQVADDHDSFMTERITG----------------GASQV
Glyma03g01180.1          (1046) ------NPCSNGCEHHF-----PMDGSMIEGING-------------------VPSQV
Glyma07g07740.1          (1048) ----EENIKFDHDPINELQDGNNEDS--------------------------NMDSP
Glyma05g37770.1          (1064) -------YEIANTTSPNGSSNAIQANQ-----PLDDTLMVESITN--------GTSQV
Glyma08g01810.1          (1066) -------YEIANTTSPDGSSNAFQANQ-----PLDETFMIESITN--------GTSQV
POPTR_0002s16080.1       (1050) LEQEGINDLHGNLREEFKRNSPDDCSDGCEHNH---Q-TEDS-MHEGLNG---GVSQV
POPTR_0014s07960.1       (1052) SEQEGINYLHGNVCEEFNRNSPDDFSNGYEHNL-----VTEDSFMLEDLKE---GASQV
clementine0.9_004500m    (1038) FDGEGVYELHGNINEELHLDSADECSKGCEHNH-----QTEESFMVDGING----AASQV
Eucgr.D02287.1           (1044) FDPEKISEFCESIPKELDMDSPDECSNGCEHNY-----QTEDSFMVDGMNG----GASQV
GSVIVT01026927001        (1054) -------GNIHEEHNIGSPDDCSNGCEDDH-------QTEDSFMLEGING----GASQV
Solyc08g081140.2.1       (1056) ------VEINSPHDSSNGFVANQ-------EAEDSLMVVDGIG-----ETSQA
Eucgr.D01841.1           (1060) -----VARELDMASPDTSSNGFEANQ--------LPENSFVVEVING------VASQA
GSVIVT01019750001        (1058) ---------------------------------------------------------
POPTR_0001s09450.1       (1070) -----CGELDITSPNRNSNDQPAAD-----------LIMVEGLNG--------GASQM
POPTR_0003s12810.1       (1072) -----RCRELDTLSPDDNSNDQAATD----------SIMVEGLNG--------GASQV
```

FIG. 21F

| | | |
|---|---|---|
| AT4G09820.1 | (1132) | -------EDVSN------QNLHSDLHIESTHTLD------------------THMDMMNL |
| Glyma03g30940.1 | (1134) | MELDATL-EEFRVGSSGDGSNHLDSFPTEKSMALCSAGLELLQLQLPPA--------- |
| Glyma19g33770.1 | (1136) | MELDHQL-EEFGVGSPGDGSNHLDSFPKEESMALCAAGLELLQLQRPPAPVDTYDKMICF |
| Glyma10g03140.1 | (1138) | ELIQLEMPEDIRLGSPNDGSNNLDSDFHLLAVSQGVNTAGQAESTR------RWGLSQNP |
| Glyma02g16670.1 | (1140) | ELMQLEMPEDIRLGSPNDGSNNLDSDFHLLAVSQGGNEARQAESTR------RWSSSQEP |
| GSVIVT01011123001 | (1142) | RLIQLEMSEGIRLGSPDDGSNNLDSDFHMLAVS---------------------QP |
| Eucgr.H01487.1 | (1144) | EPSEFEMSEDIRLGSPDDGSNNLDSDFPMLTINSTAADHQRQVDSFRAETTRRWQMMQDP |
| Eucgr.H01487.2 | (1146) | EPSEFEMSEDIRLGSPDDGSNNLDSDFPMLTINSTAADHQRQVDSFRAETTRRWQMMQDP |
| Bradi1g54070.1 | (1148) | ELMQLEIPEKVRDGCS-----SNLDDEIKMLMVCQNSNDQSDFQRQDEPYE--SWHFLYEE |
| GRMZM2G042733_T01 | (1150) | HNSEMEDDDDGRIDLE-----NNTENDS--------------------------- |
| Si029106m | (1150) | EPMQIETSESLRDGCT-----NHVDEEIPMLMACQNGDHPEQDELG--------SWHFLYED |
| LOC_Os04g47080.1 | (1022) | EQITMDDIGELYSLC-----EELDVVRPLDDDSS---------------SWAVADPW |
| LOC_Os04g47040.1 | (1020) | DELYSIY-EDLDLDMD-----LDLDTVRFLE----------------DNGWPVNP |
| Si000845m | (1030) | GGQELGEAESLSDGSL-----EQITKE--IDEFYSLCEEMDVQPL---EDTWIMD- |
| GRMZM5G822829_T03 | (1028) | EELRLREAEALSDDASL---EHITKE--IEEFYSLCDEMDLQALPLPL---EDGWTVDA |
| AT4G00480.1 | (1016) | ------HQLPLGIS----------------------------- |
| AT1G63650.1 | (1034) | QSWQFVG-EEISNCIH-----QSLNSSDCVSQTFVGTTGRLACDPRKS------RIQRLGQI |
| AT5G41315.1 | (1036) | QSWQLMD-DELSNCVH-----QSLNSSDCVSQTFVEGAAGRVAYGARKS------RVQRLGQI |
| Glyma03g01180.1 | (1046) | ---HFVNDDALVIGAP-----DSLSSCDCMSEASENQGKDSKNV----------GQTQLMEL |
| Glyma07g07740.1 | (1048) | DGFHFVN-EALVIGAP-----DSLSSCDCMSEASENQGNDSKNV----------DQTQLMEL |
| Glyma05g37770.1 | (1064) | QNWQVID-DELSNCVH-----NSMNSSDCISPTFASLENIASAPKCNNP-----SDPCARDF |
| Glyma08g01810.1 | (1066) | QNWQVID-DELSNCVH-----NSMNSSDCISQTFACPENIASAPKSNNP-----SDPCARNF |
| POPTR_0002s16080.1 | (1050) | QSWHFMD-DEFSDDVL-----DSMNSSECISEAVVKQGKAVLSSKEKNV------TRLQSQVF |
| POPTR_0014s07960.1 | (1052) | QSWHSMD-DEFSDDVR-----DSMNSSDCISEVFVKQGKVVPSSKGKDI------SHLQLKVL |
| clementine0.9_004500m | (1038) | QSWHFVD-DDLSNGIP-----DSMHSSDHKSESLVNQAEGFPSSKDENM------SHIQLKEL |
| Eucgr.D02287.1 | (1044) | QSWHFVD-DDFSNGVQ-----GSINSSDCISEAIVNQDKYISSPRRENA------KNSHLKEL |
| GSVIVT01026927001 | (1054) | QSWHFVD-DDFSNGVQ-----GSMDSSDCISQAFVNQERIHSSPKGENV------NNVRLKDL |
| Solyc08g081140.2.1 | (1056) | QSWRFMD-DNISNGAN-----NSLNSSDCISQNNANCEKLSPLSSGEKE------TKPCPLDR |
| Eucgr.D01841.1 | (1060) | QSWQFMD-DEYSNCLH-----HSVNSSDCISQTIVEPTNLRSVQ-----------EDDKANDP |
| GSVIVT01019750001 | (1058) | ----LE-DEFSNCVH-----NSMNSSDCISQTIMNPEK-------------- |
| POPTR_0001s09450.1 | (1070) | QSLQFMD-DDHSVH-----HSLNSSDCISQTIVDPVKVVPILKNVKV------NNQNLLDV |
| POPTR_0003s12810.1 | (1072) | QSWQFMD-DDFSNRVH-----HPLNSSDVSQTIVDPVMLVPFLKDGKV------NGQSLQDI |

FIG. 21G

```
AT4G09820.1         (1132) M-------------------------EEGGNYSQTVTTLLMSHPTS-LLSD----------SVSTSSYIQ
Glyma03g30940.1     (1134) -------------------------------PEKTPIKILKNIILQKNSRR-WPESPS----LNLLTDSFQ
Glyma19g33770.1     (1136) IFCFAAHPPTENLAQG----DIDTHYSQTVSSILKKNSSRW-WPDSPS--VNHPTDSFQ
Glyma10g03140.1     (1138) MQVQLPTSALHPLED-LTQEDTHYSQTVSNILQNQFTR-WPASPSS---VGYVSYSTQ
Glyma02g16670.1     (1140) MQVQLPTSEDLT------QEDTHYSQTVSNILQNQTTR-WLASPSS---IGYNTYSTH
GSVIVT01011123001   (1142) GSSPPPQPPTGPPPLDELSHEDTHYSQTVSTILQHQPNR-WSESSSS---GCIAPYSSQ
Eucgr.H01487.1      (1144) ARSGLQTPPSVPPALDELSQEDTHYSQTVSTILQNQPRW-ADS--------TSYVSYSTQ
Eucgr.H01487.2      (1146) ARSGLQTPPSVPPALDELSQEDTHYSQTVSTILQNQPRW-ADS--------TSYVSYSTQ
Bradi1g54070.1      (1148) LCSGYPQSSGENQDI-VLQPENAHYAETVMSILQRNDTR-RSYVAASHQ
GRMZM2G042733_T01   (1150) --------------------------------------------------------
Si029106m           (1150) LMNNKCLQSSAAQDPAVL-AENAHYIEAVLTILRHNACR-QAQAAASNTRTYDLAISKN
LOC_Os04g47080.1    (1022) SSFQLVPTSSPAPDQAPA-AFATDVDDVVVAALDSSS----------IDGSCRPSP
LOC_Os04g47040.1    (1020) SSFQLVPASSTEAVAAAAAND----------------------VDGVANSQV
Si000845m           (1030) GSFEVPSSQQPAPGP---------ATTNAAATS---------SALVDGSRA
GRMZM5G822829_T03   (1028) SNFEVPCSSPQPAPP----------PVDRATANVAADASRA-------PVY-GSRA
AT4G00480.1         (1016) --------------------DEDLHYKRTISTVLNYSADRSGKNDKNIRHRQPNIVTSEPG
AT1G63650.1         (1034) QEQSNHVNM-----------DDDVHYQGVISTIFKTTHQL-ILG-------PQFQNFDKR
AT5G41315.1         (1036) QEQQRNVKTLSFDPR----NDDVHYQSVISTIFKTNHQL-ILG-------PQFRNCDKQ
Glyma03g01180.1     (1046) QDCHKPKRSSLDVGA----DEDLCYIRTLCAILGNSSTF-KPN-------PYAGNSNCK
Glyma07g07740.1     (1048) QYCHKPKRSSMDVGA----DEDLCYIRTLCAILGNSSTF-KPN-------PYAGNSNCK
Glyma05g37770.1     (1064) QKCNNPKMTLVDPR-----SDEWHYQRVISTLIKNTDQL-LMG-------MHLQKFPQA
Glyma08g01810.1     (1066) QKCNNPKMTLVDPR-----SDDLHYQRVLSTLIKSSDQL-LMG-------MHLQKFPQE
POPTR_0002s16080.1  (1050) QEGNHTKLSSFDLGA----DDDLHYRRTVCVIMKSSSQS-IEN-------PCFRSGDHK
POPTR_0014s07960.1  (1052) QEGNHTKLSSLDPGA----DDDLHYRRTAFVILKSSSQL-IEN-------PCFQSGDYK
Glyma09_004500m     (1038) QEGNHTKLSLLDLGI----VDGAHYRKTLSAIFGSSNRL-TEN-------PCFLSVEHK
clementine0.9       (1044) QECNHSKLSSLDLGP----DDISHYRRTISAVLRNPDQL-PET-------RCICSCGCK
Eucgr.D02287.1      (1054) QECNDTKFSSLDLGA----DDDLHYRRTISTVLRKSHPL-IGN-------SCFRCYDIK
GSVIVT01026927001   (1056) QENDQKKPHLLDHQ-----GDDAQYQAVLSTLLKSSDQL-TLG-------PHFRNMKK
Solyc08g081140.2.1  (1060) QGCGYEKPTILENE-----IDDVHYQSVLSSLLRTSHQL-IVG-------PHFQRGNRE
Eucgr.D01841.1      (1058) ----------------------------------L-ILG-------PCFRNSNKE
GSVIVT01019750001   (1070) QDCNHTKLTSLDLQ-----KEDFHYQSVLSCLLKTSNPL-ILG-------PDVQNCHQE
POPTR_0001s09450.1  (1072) QDCNHKKLTALNLQ-----SDDLHYQSVLSCLLKTSHPL-ILG-------PNVQNCYQE
POPTR_0003s12810.1
```

FIG. 21H

| | | |
|---|---|---|
| AT4G09820.1 | (1132) SSFATWRVENG————KEHQQ———VKTAPSSQWVLKQMIFRVP————————FLHDNTKDKR |
| Glyma03g30940.1 | (1134) SAFNKWNSGAD————DYQHHFHVSVASVTSQWLLKYILFSVP————————YLHTN——— |
| Glyma19g33770.1 | (1136) SAFNKWKSDTD————NHHHYFHETVADGTSQGLLKYILFNVP————————YLHAN——— |
| Glyma10g03140.1 | (1138) SAFAKWSSRAS————HHHFHPAAAAADGTSQCILKYILFTVP————————YLHAKNPGER |
| Glyma02g16670.1 | (1140) SAFAKWSSRAS————HHFH———PAADGTSQWLLKYILFTD———————————— |
| GSVIVT01011123001 | (1142) SAFAKWTTRCD————HHHHP———MAVEGTSQWLLKYILFSVP————————FLHTKYRDEN |
| Eucgr.H01487.1 | (1144) SAFSKWTSRSD————HLLH———VPAEGTSQWLLKYILFTIP————————FLHTKYRDEN |
| Eucgr.H01487.2 | (1146) SAFSKWTSRSD————HLLH———VPAEGTSQWLLKYILFTIP————————FLHTKYRDEN |
| Bradi1g54070.1 | (1148) SSFSTWHPTML-QQGRTAT————GAGGTTQQRMLGSLLFNNA———————AAAASGYG |
| GRMZM2G042733_T01 | (1150) ———————————————TRRH————LPQDASVGNELETLNAESS————————————— |
| Si029106m | (1150) SPFSRWNPNKG-TSDLQRM————LISEGTPQRMLKSILFTSAPTRCSSHQRHRGEATQS |
| LOC_Os04g47080.1 | (1022) SSFVAWKRTAD————SDEVQAVPLISGEPPQKLLKKAVA————————————GAGA |
| LOC_Os04g47040.1 | (1020) SCFMAWKSAKS————NEMAVP———VVTGIESQKLLKKVVDCGA————————RMSTGRGSRA |
| Si000845m | (1030) TSFTAWARPES————DSNEVA———VPVVEEPQKLLKKAV———————————————AGGA |
| GRMZM5G822829_T03 | (1028) TSFMAWTRSSQQSSCSDDAAPAAVVPAIEEPQRLLKKVA———————————————GGGA |
| AT4G00480.1 | (1016) SSFLRWKQCEQ————QVSG———FVQKKKSQNVLRKILHDVP————————LMHTK-RMFP |
| AT1G63650.1 | (1034) SSFTRWKRSSS————V—————KTLGEKSQKMIKKILFEVP————————LMNKKEELLP |
| AT5G41315.1 | (1036) SSFTRWKKSSS————SSSGT———ATVTAPSQGMLKKIIFDVP————————RVHQK——— |
| Glyma03g01180.1 | (1046) SSFAKWKKGRV————SERK———RPK-LHQSMLKKTLFKVP————————FMHRSYSSLK |
| Glyma07g07740.1 | (1048) SSFAKWKKGRV————SERK———RPK-LHQSMLKKTLFNVP————————FMHRSYSSLK |
| Glyma05g37770.1 | (1064) SSFVSWRKGEP————MDSQ———WPRAGTSQKLLKKVLFEVP————————QMHLD-GLHE |
| Glyma08g01810.1 | (1066) SSFVSWRKEQP————MDCK———WPRAGTSQKLLKKVLFEVP————————QMHLD-GLHE |
| POPTR_0002s16080.1 | (1050) SSFFSWKKR-A————VDGV———MPR-VQQNMLKKILFAVP————————LIYGG-HSLR |
| POPTR_0014s07960.1 | (1052) SSFVGWKKGAA————DGY————KPR-IQQKMLKKILFAAP————————LMHGG-HSIR |
| clementine0.9_004500m | (1038) SSFVSWKKGGM————VKRH———WP-GIQQNLLKKILFSVP————————LMHGG-CTHR |
| Eucgr.D02287.1 | (1044) SSFLRWRM——————VEVH———KPR-AHQETLKKILFEVP————————LMHRG-QALK |
| GSVIVT01026927001 | (1054) SSFITWKKGGM————LDAQ———KPQ-TQQRILKKILFTVP————————LMHGG-CGFK |
| Solyc08g081140.2.1 | (1056) SSFASWK———————TDIQ———MPRFGTAQKLLKKVLLEVP————————RMHAG-VIHK |
| Eucgr.D01841.1 | (1060) SSFVAWKKGWF————PSRQ———TTQGGTPQEVLKRILFQVP————————RMYDN-ALQ |
| GSVIVT01019750001 | (1058) SSFVSWKKRGL————MGTQ———KLNTGTQQKLLKKVLFEVA————————QMHGG-CLMS |
| POPTR_0001s09450.1 | (1070) SSFVSWKKAGS————VHTH———KLKSGTRQKVLKKILLEVP————————RMHVD-GLLD |
| POPTR_0003s12810.1 | (1072) PSFVSWKKAGL————MHSQ———KLKSGTPQKLLKKILFEVP————————RMHVD-GLLD |

FIG. 21I

```
AT4G09820.1        (1132) LPRE---------------DLS---HVVAERRRREKLNEKFITLRSMVP-FVTK
Glyma03g30940.1    (1134) ---------WLKGKGTSPYE-------TSHVMAERHRREKLNERFLILRSMVP-SVTR
Glyma19g33770.1    (1136) ---------RLKGTGASSYE-------TNHVMAERRRREKLNERFLILRSMVP-FMMR
Glyma10g03140.1    (1138) SAAGGAQRQPRAGRAPPPREAEREVHNPAVAGPLRDQNGQGVDIGRHHRVREAVA----
Glyma02g16670.1    (1140) ---------------------------ELS-ANHVLAERRRREKLNERFIILRSLVP-FVTK
GSVIVT01011123001  (1142) SPKSRDGDSAGRFRKGTPQD-------ELS-ANHVLAERRRREKLNERFIILRSLVP-FVTK
Eucgr.H01487.1     (1144) SPKSRDGDSSSRFRKGNPQD-------ELS-ANHVLAERRRREKLNERFIILRSLVP-FVTK
Eucgr.H01487.2     (1146) SPKSRDGDSSSRFRKGNPQD-------ELS-ANHVLAERRRREKLNERFIILRSLVP-FVTK
Bradi1g54070.1     (1148) KPAD---DIRGEGGPRREAA-------DLS-ANHVLQERKRREKLNERFIILRSLVP-FVTK
GRMZM2G042733_T01  (1150) ----GPMLIANLTAQ------------DEYCPLHRFHSEDLSSKYL--------QSSG
Si029106m          (1150) PEEPAGRDDGDGTGRSRRGQGQAQAELS-ASHVLKERQRREKLNERFIILRSLVP-FVTK
LOC_Os04g47080.1   (1022) WM-------NNGDSSAAAMTQ------GSSIKNHVMSERRRREKLNEMFLILKSVVP-SIHR
LOC_Os04g47040.1   (1020) ALTQ-------------------ESGIKNHVISERRRREKLNEMFLILKSIVP-SIHK
Si000845m          (1030) WAAN-------NGGGGTTRMAQ------ESGVKNHVMSERKRREKLNEMFLVLKSLVP-SIHK
GRMZM5G822829_T03  (1028) WE----SCGGATGAAQEMS--------GTGTKNHVMSERKRREKLNEMFLVLKSLLP-SIHR
AT4G00480.1        (1016) SQ---------------------NSGLNQDDPSDRRKE-----NEKFSVLRTMVP-TVNE
AT1G63650.1        (1034) DTPE----------------------ETG-NHALSEKKRREKLNERFMTLRSIP-SISK
AT5G41315.1        (1036) -----EKLMLDSPEAR----------DET-GNHAVLEKKRREKLNERFMTLRKIIP-SINK
Glyma03g01180.1    (1046) SQKG---NDRMEWTSKLEND-------DHGLIGKAFSDKKRE-----IKNFQVVKSMVPSSISE
Glyma07g07740.1    (1048) SQKE---NGRMKWTSKLENA-------NDGFMEKTFSDKKRE-----NKNFHVVKPMVPSSISE
Glyma05g37770.1    (1064) SQEE---NDYKEGMRVEAD--------ENG-MNHVMSERRRAKLNQRFLTLRSMVP-SISK
Glyma08g01810.1    (1066) SQEE---NDYKEGMRVEAD--------ENG-MNHVMSERRRAKLNERFLTLRSMVP-SISK
POPTR_0002s16080.1 (1050) FDKE---NGGTDCLKKLEGC-------ETC-KEHYKSDKQRV-----NDKFIVLRSMVP-SISF
POPTR_0014s07960.1 (1052) SDKE---NAGKDCLKNLEGC-------ETC-KLHFESEKQKE-----NEKYLALESIVA-SINE
clementine0.9_004500m (1038) SQKE---ICRKYCPVTMESD-------NFC-EEHISSDKRTE-----NEKFMVLRSMVP-YISE
Eucgr.D02287.1     (1044) SELQ---NGVESLLGDVDFC-------------AGHILSTKKKE-----HEKFLVLRSMIP-SIEF
GSVIVT01026927001  (1054) SQKE---NAGRDGLWKSGSD-------GIC-KQHALSDKKRE-----KEKFLVLRSMVP-SINK
Solyc08g081140.2.1 (1056) FSRE---NGKKNSLWRPEVD-------DID-RNRVISERRREKINERFMHLASMLP-TSSK
Eucgr.D01841.1     (1060) SPLE---DGGENGVWRPEAD-------EIG-LNHAILERKQKEKINDRLGVLKSMVP-SVSK
GSVIVT01019750001  (1058) SRDN---NGDNDEIWRPEAD-------EIT-LNHVLSERKRREKINERFSVLRSLVP-SINQ
POPTR_0001s09450.1 (1070) SPEY---NSNKVVVGRPEAD-------ENG-ASHALSERKQREKLNKRFMILKSIVP-SISK
POPTR_0003s12810.1 (1072) SPEY---SSDKVVGGRPEAD-------EIG-ASHVLSERRRREKLNKRFMILKSIVP-SISK
```

FIG. 21J

```
AT4G09820.1              (1132) -MDKVSILGDTIAYVNHLRKRVHELENTHH----------------------------
Glyma03g30940.1          (1134) -MDKASILGDTIEYIKQLRDKIESLEARKR----------------------------
Glyma19g33770.1          (1136) -MDKESILEDTIHYIKQLREKIESLEARER----------------------------
Glyma10g03140.1          (1138) -AEDPGARGALYIYI-------------------------------------AVQRT
Glyma02g16670.1          (1140) -MDKASILGDTIEYVKQLRKKIQELEAQRVWFYN------------------TVAVQ
GSVIVT01011123001        (1142) -MDKASILGDTIEYVKQLRKKIQDLEARTR-QMEVEQRSRGSDSVRSKEH--RIGSG
Eucgr.H01487.1           (1144) -MDKASILGDTIEYVKQLRKKIQDLEARNRQMEADHRTKEGELQRTTSLKDLRSAASSVE
Eucgr.H01487.2           (1146) -MDKASILGDTIEYVKQLRKKIQDLEARNRQMEADHRTKEGELQRTTSLKDLRSAASSVE
Bradi1g54070.1           (1148) -MDKASILGDTIEYVKQLRSRIQDLESSSTR------------------------QQQQQ
GRMZM2G042733_T01        (1150) -AEDQAAVAENAHYIKTV----------------------------------------
Si029106m                (1150) -MDRASILGDTIEYVKQLRRRIQDLESLRA-----------------------SKEKR
LOC_Os04g47080.1         (1022) -VDKASILAETIAYLKELEKRVEELESSSQ---------------PSPCPLE--TRSRR
LOC_Os04g47040.1         (1020) -VDKASILEETIAYLKVLEKRVKELESSSE---------------------PSHQR
Si000845m                (1030) -VDKASILAETIAYLKELQRRVQELESSREPII------------SRPSETT--RATRR
GRMZM5G822829_T03        (1028) -VNKASILAETIAYLKELQRRVQELESSRE--------------PASRPSETTRLITRPSR
AT4G00480.1              (1016) -VDKESILNNTIKYLQELEARVEELESCMG-SVNFVER------QRKTTENLNDSVLIEET
AT1G63650.1              (1034) -IDKVSILDDTIEYLQDLQKRVQELESCRE-SADTETR-ITMMKRKKPDD------EEERA
AT5G41315.1              (1036) -IDKVSILDDTIEYLQELERRVQELESCRE-STDTETRGTMTMKRKKPCD------AGERT
Glyma03g01180.1          (1046) -VEKISILGDTIKYLKKLETRVEELESYME-VTGPEAR-------KRSKCPD---VLEQM
Glyma07g07740.1          (1048) -VEKISILGDTIKYLKKLETRVEELESYME-VTDPEAR-------IRRKCPD---VPPEQM
Glyma05g37770.1          (1064) -DDKVSILDDAIEYLKKLERRINE-LEAHRG-VTDIETG------TRRSPQD---TVERT
Glyma08g01810.1          (1066) -DDKVSILDDAIDYLKKLERRVKE-LEAHRV-VTDIETG------TRRSPQD---TVERT
POPTR_0002s16080.1       (1050) -IDKESILSDTINYLKQLESRVAE-LESCKG-WIDHEAG------HRRSYMD---MVDQT
POPTR_0014s07960.1       (1052) -IDKASILSDTINYPRQLESRVAE-LESCTG-STDYEAR------SRSYMG---MVDRT
clementine0.9_004500m    (1038) -VDKASILSDTIKYLKKLEARVEE-LESCMY-SVDSEPR------PKRNYTE---MVEQT
Eucgr.D02287.1           (1044) -IDKASILDDTIMYLRELEARVEE-LESCMD-STDLEGK------VTRKKFPD--MIEQT
GSVIVT01026927001        (1054) -IDEVSILGDTIEYLKKLEARVEE-LETSMDLQTELEAR------ARQKYLD---MVEQT
Solyc08g081140.2.1       (1056) -VDKISLLDETIEYMKELERRVQE-LEARSA--------------RRSND----TAEQT
Eucgr.D01841.1           (1060) -VDKLSILDDTIAYLRELQRKVEE-LESWGI-GMEVEAK------SRRKPHD---MVERT
GSVIVT01019750001        (1058) -VNKVSVLDDTIEYLKELKRRVEE-LESSKE-STEIEAR------TSRRTPD---TAERT
POPTR_0001s09450.1       (1070) VVDKVSILDETIEYLQELERKVEE-LGSNRELLEVL--------TKRKPQD---TAERT
POPTR_0003s12810.1       (1072) -VDKVSILDDTIQYLQELERKVEE-LECRRELLEAI--------TKRKPED---TVERT
Consensus                (1154) ----------SXLXXXIXYXXLXXXXEL------------------------------
```

FIG. 21K

```
AT4G09820.1          (1132) ----------------EQQHKRTRTCKRKT---------------------SEEVEVSIIE-NDVLLE
Glyma03g30940.1      (1134) ----------------------LTGKRR----------------------MRQVEVSIIE-SEALLE
Glyma19g33770.1      (1136) ----------------------LRGKRR----------------------VREVEVSIIE-SEALLE
Glyma10g03140.1      (1138) SSSSSKE-QQRSGVTMTEKRKVRIVEGVVAKAKAVEAEATT---SVQVSIIE-SDALLE
Glyma02g16670.1      (1140) RTSSSSSKEQQRSGVTMMEKRKVRIVEGVVAAKAKAVEVEATT---SVQVSIIE-SDALLE
GSVIVT01011123001    (1142) GVDRNRAVVAGSDKRKLRIVEGSTGAKPKVVDSPPAAVEGGT-TTVEVSIIE-SDALLE
Eucgr.H01487.1       (1144) RSSRASLPGSGSDKRKRMRIVEGGSGAKPKAVESPPPPLPPPTSETSVQVSIIE-SDALLE
Eucgr.H01487.2       (1146) RSSRASLPGSGSDKRKRMRIVEGGSGAKPKAVESPPPPLPPPTSETSVQVSIIE-SDALLE
Bradi1g54070.1       (1148) VHGGGGGELARSAKRKMATRAAVEGCSASSSSSAPPSSSLAAAAEVQVSIIE-SDALLE
GRMZM2G042733_T01    (1150) ------------------------------------------------------LTILRF
Si029106m            (1150) AQSTSSA----TMAEAWSKVRAVEASSSCSTSGAGRPASVAS-TEVQVSIIE-SDALVE
LOC_Os04g47080.1     (1022) KCREITGKKVSAGAKRKAPAPEVASDDDTDGERRHC-----------VSNVNVTIMDNKEVLLE
LOC_Os04g47040.1     (1020) ATETGQQRRCEITGKELVSEIGVSGGGDAGRE------------------HHHVNTVTD-KVVLLE
Si000845m            (1030) HDDEAVRKKVCAAGSK----RKGSELGGDVEREHHPRALSKDS-TSNVTVTVSD-KEVLVE
GRMZM5G822829_T03    (1028) GNNESVRKEVCAG-------SKRKSPELGRDDVERPPVLIMDAG-TSNVTVTVSD-KDVLLE
AT4G00480.1          (1016) SGNYDDS--------------TKIDDNSGETEQVTVFRDK-THLRVKLKE-TEVVIE
AT1G63650.1          (1034) SANCMNS---------------KRKGSDVNVGEDEPADIGYAGLT-DNLRISSLG-NEVVIE
AT5G41315.1          (1036) SANCANN-ETGNGKKVSVN------NVGEAEPADTGFT----GL-TDNLRIGSFG-NEVVIE
Glyma03g01180.1      (1046) SDNYGTR-KICMGMKPWMNKRKACGIDEIDTELERITSEEAK-ALDVKVNVKD-QEVLIE
Glyma07g07740.1      (1048) SDNYGTR-KICMGMKPWVNKRKACGIDEIDTELERIVSEESK-VLDVKVNVKE-QEVLIE
Glyma05g37770.1      (1064) PDHYFSKNNNNNNGKKPGMKKKRKACGVDEKGREINLDALKGSY-ANDVIVSTSD-NGIVIE
Glyma08g01810.1      (1066) SDHYFRK-NNNGKKPGMKKKRKACGVDETEKEINSDALKGSY-ANDVTVSTSD-NEIVIE
POPTR_0002s16080.1   (1050) SDNDDIK-KIDNGKRSWVNKRKALDIDEAELELDGVSPKDGM-PLDLKVCTKE-KEVLIE
POPTR_0014s07960.1   (1052) SDNHGIK-----KPWINKRKARDIDEAELELDEVAPKDGM-PVDLKVCMKE-KEILIE
clementine0.9_004500m (1038) SDNYDNK-KLDNHKKPWINKRKACDIDETDPELNKFVPKDGL-ADVKVSIQE-MDVLIE
Eucgr.D02287.1       (1044) SDNC------KKRWINKRKASDIDETDAELDRNAQGDGL-QTDVKVNIKE-QEVSIE
GSVIVT01026927001    (1054) SDNYDDK-MIDDGKKLWINKRKACDIDETDLEINEIIPKDSLPSSDMKVRINE-QEVLIE
Solyc08g081140.2.1   (1056) SDNCGTS-KFNDIRGSLPNKRKACDMDEIEPESSNGLLKCSS-ADSIVINMID-KEVSIK
Eucgr.D01841.1       (1060) SDNCGTH-VTGSGKKPVRNKRKASNIDSMELETNSVVQRDVS-ADNLTVKIND-RTVLIE
GSVIVT01019750001    (1058) SDNYGND-RVGNGKKPLLNKRKACDIDEMEPDSNRVLLKDDS-AENITVNMNE-KDILIE
POPTR_0001s09450.1   (1070) SDNYGSN-KIGNGKHSLTNKRKAPDIDEMEPDINHNVSKDGS-AESITVSVNK-EDVLIE
POPTR_0003s12810.1   (1072) SDNCGSN-KIGNGKNSLTNKRKAPDIDEMEPDTNHNISKDGS-ADDITVSMNK-GDVVIE
```

FIG. 21L

```
AT4G09820.1              (1132) MRCEYRDGLLLDILQVL-HELGIETTAVHT-SVNDHDFEAEIRAKVR----GKKASI---
Glyma03g30940.1          (1134) VECVHREGLLLDLMTKL-RELGVEVMMVQSWVKDDGVFVAEMRAMVRENGNGIKAMI---
Glyma19g33770.1          (1136) VECVHRERLLLDVMTML-RELGVEVMMVQSWVKDDGVFVAEMRAKVKENGNGKKASV---
Glyma10g03140.1          (1138) IECRHKEGLLLDVMQML-REVRIEVIGVQS-SLNNGVFVAELRAKVKEHANGKKVSI---
Glyma02g16670.1          (1140) IECRHREGLLLDVMQML-REVRIEVIGVQS-SLNNGVFVAELRAKVKEHANGKKVSI---
GSVIVT01011123001        (1142) MQCPYREGLLLDLMQML-RDLRLETTVQS-SLTNGVFVAELRAKVKENASGKKASI---
Eucgr.H01487.1           (1144) LQCPHREGLLLDLMQML-RDLRIETTAVQS-SLTNGFFVAELRAKVKENVNGKKASI---
Eucgr.H01487.2           (1146) LQCPHREGLLLDLMQML-RDLRIETTAVQS-SLTNGFFVAELRAKVM------PSYI---
Bradi1g54070.1           (1148) LRCPDRRGLLLRIMQAVQDQLRLDVTAVRA-SSDDGVLLAELRAKVRE-VHGRRSSI---
GRMZM2G042733_T01        (1150) NACRQTQAGLLKHRQNLPGTLQ--------ELAILKMELEAQRN-------------
Si029106m                (1150) LRCPRRDGLLLRVMQALHRELGLEVTSVQA-SSAGDVLLVELRAKVKEVHGG-RSTI---
LOC_Os04g47080.1         (1022) LQCQWKELLMTRVFDAI-KGVSLDVLSVQA-STSDGLLGLKIQAKFA--SSAAVEPG---
LOC_Os04g47040.1         (1020) VQCRWKELVMTRVFDAI-KSLCLDVLSVQA-SAPDGLLGLKIQAKFA--CSGSVAP---
Si000845m                (1030) VQCRWEELLMTRVFDAI-KSLQLDVLSVQA-SAPDGFMGLKIRAQFA--GSAAVVP---
GRMZM5G822829_T03        (1028) VQCRWEELLMTRVFDAI-KSLHLDVLSVQA-SAPDGFMGLKIRAQFA--GSGAVVP---
AT4G00480.1              (1016) VRCSYRDYIVADIMETL-SNLHMDAFSVRS-HTLNKFLTLNLKAKFR--GAA-VASV---
AT1G63650.1              (1034) LRCAWREGILLEIMDVI-SDLNLDSHSVQS-STGDGLLCLTVNCKHK--GTK-IATT---
AT5G41315.1              (1036) LRCAWREGVLLEIMDVI-SDLHLDSHSVQS-STGDGLLCLTVNCKHK--GSK-IATP---
Glyma03g01180.1          (1046) MKCPYRKYILYDIMDTI-NNLHLHDAQTVES-STSDGVLTLTLKSKFR--GAA-TAPM---
Glyma07g07740.1          (1048) MKCPYREYILYDIMDTI-NNLHLHDAQTVES-STSDGVLTLTLKSRKVLLGISRSSNSTNE
Glyma05g37770.1          (1064) MKCPSRAGRMLEIMEAI-NSFNIDFSSVQS-TEADGNLYLTIKSVLT--GPR-VATA---
Glyma08g01810.1          (1066) LKCPSKAGRLLEIMEAI-NSFNIDFSSVQS-TEADGNLYLTIKSVLT--GPS-VATT---
POPTR_0002s16080.1       (1050) IRCPYREYMLLDIMDEI-NKLQLDVHSVQS-STLDGIFALTIKSKFR--GAA-VAPA---
POPTR_0014s07960.1       (1052) MRCPYREYMLLDILDEA-NKRQLDVLSVHS-STLDGIFTLTLKSKFR--GAAPVSPE---
clementine0.9_004500m    (1038) MRCPSREYILLDIMDAI-NNLHLDAYSVVS-SNLDGVLTLALKSTFR--GAA-IAPA---
Eucgr.D02287.1           (1044) MKCPYREYLLLDILEAV-NNLHLDAYSIQS-STLDGVKLTLKSKFR--GAA-VSPA---
GSVIVT01026927001        (1054) MRCPWREYLLLDIMDAI-NNLHLDCHSVQS-SNHDGFLTLTLKSKFR--GRA-VASA---
Solyc08g081140.2.1       (1056) MSCLMWSESLLLKIMEAL-TDLHMDCHTVQS-SNLDGILSIAIESKST-GSKTLAV---
Eucgr.D01841.1           (1060) MRCSSREGVLLEIINEV-NNLHLDSHSVQS-STIDGILSLTIKSKFT--GST-VMSA---
GSVIVT01019750001        (1058) LRCPWRECLLLEIMDAV-SNLHLDSQSVQS-ASVDGILSLTIKSKFK--GSS-FASA---
POPTR_0001s09450.1       (1070) IKCRWREGILLEIMDVA-SHLHLDSHSVQS-STMDGILSLTIKSKHK--GLN-ATSI---
POPTR_0003s12810.1       (1072) IKCLWREGILLEIMDAA-SHLHLDSHSVQS-SIMDGILSLTIKSKHK--GLN-AASV---
```

FIG. 21M

| | | |
|---|---|---|
| AT4G09820.1 | (1132) | ---AEVKRAIHQVIIHDTNL--------------------- |
| Glyma03g30940.1 | (1134) | ---------IFSHAFGLR----------------------- |
| Glyma19g33770.1 | (1136) | ---VEVKNALNQIIPHHEPYTLCSNDHF------------- |
| Glyma10g03140.1 | (1138) | ---VEVKRALNQIIPHAVD---------------------- |
| Glyma02g16670.1 | (1140) | ---VEVKRALNQIIPHAVD---------------------- |
| GSVIVT01011123001 | (1142) | ---MEVKRAINQIIPQC------------------------ |
| Eucgr.H01487.1 | (1144) | ---VEVKRAIQQLIPHTDS---------------------- |
| Eucgr.H01487.2 | (1146) | ---FGVLGFDWLFRS-------------------------- |
| Bradi1g54070.1 | (1148) | ---SEVKRAIHLIISSG------------------------ |
| GRMZM2G042733_T01 | (1150) | ---KQHVDP-------------------------------- |
| Si029106m | (1150) | ---NEVKRTIHLIISSSG----------------------- |
| LOC_Os04g47080.1 | (1022) | ---GMISEALQKAIGG------------------------- |
| LOC_Os04g47040.1 | (1020) | ---WMISEALRKAIGKR------------------------ |
| Si000845m | (1030) | ---WMISEALRKAIGKR------------------------ |
| GRMZM5G822829_T03 | (1028) | ---GMIKRELRRVIGDLF----------------------- |
| AT4G00480.1 | (1016) | ---GMIQEALQRVAWIC------------------------ |
| AT1G63650.1 | (1034) | ---GMIKEALQRVAWIC------------------------ |
| AT5G41315.1 | (1036) | ---RMIKEALWKVSGNI------------------------ |
| Glyma03g01180.1 | (1046) | DDQRSTLESIWKYLTCLFGFHMIVLVVVIVNIYD |
| Glyma07g07740.1 | (1048) | ---KRIKLALQKVASKC------------------------ |
| Glyma05g37770.1 | (1064) | ---KRIKQALQKLASKC------------------------ |
| Glyma08g01810.1 | (1066) | ---GMIEQALWKIAGKT------------------------ |
| POPTR_0002s16080.1 | (1050) | ---GMIKQALRKTVGKT------------------------ |
| POPTR_0014s07960.1 | (1052) | ---GIIEQALWKIAGKC------------------------ |
| clementine0.9_004500m | (1038) | ---GMVKQVLWKITGKY------------------------ |
| Eucgr.D02287.1 | (1044) | ---GMIKQALWRITSKC------------------------ |
| GSVIVT01026927001 | (1054) | ---GTIREALQRVVWKS------------------------ |
| Solyc08g081140.2.1 | (1056) | ---ATIKQALWRFARKCGNSSPY------------------ |
| Eucgr.D01841.1 | (1060) | ---ETIRQALQRVVPKC------------------------ |
| GSVIVT01019750001 | (1058) | ---GTIKQALRRVAGKC------------------------ |
| POPTR_0001s09450.1 | (1070) | ---GTIKHALQMVAGNLFSNR-------------------- |
| POPTR_0003s12810.1 | (1072) | | |

FIG. 21N

```
AT4G09820.1              (1132) ----------------
Glyma03g30940.1          (1134) ----------------
Glyma19g33770.1          (1136) ----------------
Glyma10g03140.1          (1138) ----------------
Glyma02g16670.1          (1140) ----------------
GSVIVT01011123001        (1142) ----------------
Eucgr.H01487.1           (1144) ----------------
Eucgr.H01487.2           (1146) ----------------
Bradi1g54070.1           (1148) ----------------
GRMZM2G042733_T01        (1150) ----------------
Si029106m                (1150) ----------------
LOC_Os04g47080.1         (1022) ----------------
LOC_Os04g47040.1         (1020) ----------------
Si000845m                (1030) ----------------
GRMZM5G822829_T03        (1028) ----------------
AT4G00480.2              (1016) LIHNSWAICIFH
AT1G63650.1              (1034) ----------------
AT5G41315.1              (1036) ----------------
Glyma03g01180.1          (1046) ----------------
Glyma07g07740.1          (1048) ----------------
Glyma05g37770.1          (1064) ----------------
Glyma08g01810.1          (1066) ----------------
POPTR_0002s16080.1       (1050) ----------------
POPTR_0014s07960.1       (1052) ----------------
clementine0.9_004500m    (1038) ----------------
Eucgr.D02287.1           (1044) ----------------
GSVIVT01026927001        (1054) ----------------
Solyc08g081140.2.1       (1056) ----------------
Eucgr.D01841.1           (1060) ----------------
GSVIVT01019750001        (1058) ----------------
POPTR_0001s09450.1       (1070) ----------------
POPTR_0003s12810.1       (1072) ----------------
```

FIG. 21O

```
Bradi1g07970.1       (1218) MADRRGD------------------------AMRQQQQPFGSGQERVFD--------------GGGGG
GRMZM2G008029_T01    (1204) MDDRRGR-----------------GDALGQRPFASAAQ---------RQERVFDGGG---------GGGGG
Bradi1g22680.1       (1220) MAAEQWS------------GGGG-----------------GLWAP-PSA-AMESLFP-------------D
LOC_Os07g40570.1     (1198) MAAARRV------AGGGGGSLWGPPQP--------------PPS-------------------------TGGGI
Solyc03g104810.2.1   (1178) MGENFKA------PSVSVSSLS---------TLTIP------PKDSFFGGG-----------------NMPYF
Glyma08g26230.1      (1168) MSTPNTD------------SGTAPPPRP-TITLP--PRP-SAEAFFS-----------------AAAGA
Glyma18g49830.1      (1170) MYTPNAD-----------SGTA----PHPRP-TITLP--PRP-SAEAFFS-----------------AAGGA
POPTR_0004s12000.1   (1186) MAEKQEN----------------PTTAAPAKP-TITLP--PRP-SMETLFT-----------------GGL
POPTR_0017s12430.1   (1188) MAEKQQN-----------LTTAPAPARP-TITLP--PRP-SMETLFT-----------------GGL
Solyc05g012770.2.1   (1174) MAENEG-----------SSSSSTSRGQLLRP-TITLP--PRS-SMESLFSG----------------GSSGI
AT1G13960.1          (1158) MSEKEE---------APSTSKSTGAPSRP-TLSLP--PRP-FSEMFFN-----------------GGVGF
AT2G03340.1          (1156) MAEKEEK--------EPSKLKSSTGVSRP-TISLP--PRP-FGEMFFS-----------------GGVGF
POPTR_0008s09140.1   (1190) MADEKEH--------QQPKQQQ--PSSRPITITLP--PRS-FTETFLSSGPP--------------GSMGF
POPTR_0010s17040.1   (1192) MTENGKEHQQPKQQQPSSPSKSLSSRPTTITLP--PRS-FTETFFSSGAP--------------GTLGF
Glyma20g03410.1      (1166) MVDGGK---------GEGGGEQASPPSTAARHGTTLRPRA-SVESVFS-----------------GGY
Glyma01g06550.1      (1160) MAGGGGG--------DRPPWKEA-APPRP-TITLP--PRSGSMETLFN-----------------GGF
Glyma02g12490.1      (1162) MAGGGGG--------DRPPWKEA-EPPRP-TITLP--PRSGSMESLFN-----------------GGF
Bradi4g06690.1       (1224) MSSRPP-----------------PPPRP-HLSLP--PRS-TAESLFT-----------------GVGDA
Si021859m            (1216) MSARPP-----------------PPPRP-HLALP--PRS-AAESLFT-----------------GAGDA
GRMZM2G143765_T01    (1212) MSARPP-----------------PQPRP-RLALP--PRS-TAESLFT-----------------GAGDT
GRMZM2G076657_T01    (1208) MSARPP-----------------PPPRP-RLALP--PRS-TAESLFT-----------------GAGDA
GRMZM2G076657_T02    (1210) MSARPP-----------------PPPRP-RLALP--PRS-TAESLFT-----------------GAGDA
LOC_Os03g33012.1     (1200) MAAHEGG--------GNGARRPPAPLLP-TLSLP--PRS-AAGSLFS-----------------AES
Bradi1g16120.1       (1222) MAAHEAS--------ASGGEGARRPPPRP-ALSLP--PRA-AAESFFAAAG---------------SAAES
GRMZM2G171428_T01    (1206) MAAREASAPAPA-SPHAGDGPGRPPRP-TLALP--PRS-AVESLFATGASSSA--GAAET
Si035317m            (1214) MAAHEASASA---PAAGDGAARRPPRP-TLALP--PRS-AVESLFAGAGGSSSAGAAET
Si012785m            (1330) ------------MEEWKDPNP----------------PES-LMRGFQI--------------GTF
GRMZM5G816457_T01    (1326) MEGH--------VAMEWNDPNPGPESLISFQTEAVRPDTAGGHSN---------------DDVEA
GRMZM5G816457_T02    (1328) MEGH--------VAMEWNDPNPGPESLISFQTEAVRPDTAGGHSN---------------DDVEA
GRMZM2G031963_T01    (1324) MEGH--------VAMGWKDPNPGQESSMVFQSRAVRPDTVEGHSN---------------EDVEA
Glyma04g12830.1      (1334) MAGIDDNVG---LIGDWGLASPSPR--TFFSRMFEED-SVTRSISEHSGSGRTGDLFSG
Glyma06g47880.1      (1336) MAGIDDNVA---LIGDWGLASPS---------PRT-FFSRMLE----------
Bradi4g33370.1       (1302) MAGTSDRGS---IMEDWMAMPPTPSPRTLMSSFLNED-FSSGPFSNLFSENGSNKPHDH
LOC_Os08g38990.1     (1306) MDGTNNH-----GALMDDWMLPSPSPRTLMSSFLNEE-FSSGPFSDIFCD-----NGSNK
LOC_Os08g38990.3     (1312) MDGTNNH-----GALMDDWMLPSPSPRTLMSSFLNEE-FSSGPFSDIFCD-----NGSNK
Si013374m            (1316) MAGTDNR-----RALMEDWMLPSPSPRTVMSSFLNEE-FSSCPFSSIFSDNGSSKPLDA
```

FIG. 24A

```
Bradi1g07970.1          (1218) GPA-----------FGGD--------------------YDHASSYMALLGTGVNPQP---------------
GRMZM2G008029_T01       (1204) GHGPA---------FGDE--------------------FDQGSSLMALLSAGARAVS---------------
Bradi1g22680.1          (1220) EPAPAAAVLGIF----------------------------------GAWGLQ-------------------
LOC_Os07g40570.1        (1198) PQLPAAAAPVEG--------------------LLDAPFSSSGGGGGWPPP---------------------
Solyc03g104810.2.1      (1178) SPGPMTLVSTFFSES-----------------EYPSFSQLLAGAMASP-----------------------
Glyma08g26230.1         (1168) SPGPMTLVSSFFGSD-----------------AAADCRSFSQLLAGAMASP-------------------M
Glyma18g49830.1         (1170) SPGPMTLVSSFFGSD-----------------AAADCRSFSQLLAGAMASP------------------MA
POPTR_0004s12000.1      (1186) SPGPMTLVSSFFADTP-----------------YPESDYPSFSQLLA------------------------
POPTR_0017s12430.1      (1188) SPGPMTLVSSFFADSP-----------------YPESDYRSFSQLLAGAMASPIASPAFFNDHS--------
Solyc05g012770.2.1      (1174) SPGPMTLVSSFFSDN-----------------DPDSECRSFSQLLAGAMTPP-------------------
AT1G13960.1             (1158) SPGPMTLVSNMFPDS-----------------DEFRSFSQLLAGAMSSP-------------ATAAAAA
AT2G03340.1             (1156) SPGPMTLVSNLFSDP-----------------DEFKSFSQLLAGAMASPAAAAVAAAAVV
POPTR_0008s09140.1      (1190) SPGPMTLLSGFFSDS-----------------DDCKSFSQLLAGATASP---------------------
POPTR_0010s17040.1      (1192) SPGPMTLLSSFFSDS-----------------DDCKSFSQLLAGAIASP---------------------
Glyma20g03410.1         (1166) SPGPMALLSNFYGDG-----------------DECKSFSELLAGAMVDP---------------------
Glyma01g06550.1         (1160) SPGPMTLLSGFLGDG-----------------DDGKSFSQLLAGAMASP---------------------
Glyma02g12490.1         (1162) SPGPMTLLSSFWGDG-----------------DDGKSFSQLLAGAMSSP---------------------
Bradi4g06690.1          (1224) SPGPLTLASALFSSDSDADGGGGGGSASSGSGPTSFTQLLIGNLSQP-------------------PQQ
Si021859m               (1216) SPGPLTLASALFPSDADAGGGGGPGG---GASSGAAFTQLLTGSLPQP-----------------------
GRMZM2G143765_T01       (1212) SPGPLTIASALFPSDADGGGGGPGGAS---SSAAGAATFTQLLTGSLAPP-------------------P
GRMZM2G076657_T01       (1208) SPGPLTIASALFPSDADGGGGPGGAS----SSAAGAATFTQLLTGSLAPP-------------------
GRMZM2G076657_T02       (1210) SPGPLTIASALFPSDADGGGGPGGAS----SSAAGAATFTQLLTGSLAPP-------------------
LOC_Os03g33012.1        (1200) SPGALTLAASLFPDA-----------------PSPAFQGSFTQLLVGAMGYP-----------------
Bradi1g16120.1          (1222) SPGPLTLAAALFPDM-----------------PSPAFHGSFTQLLVGAMGSP-----------------
GRMZM2G171428_T01       (1206) SPGPLTLAAALFPDA-----------------SSPAFHGSFTQLLVGAIGSP-----------------
Si035317m               (1214) SPGPLTLAAALFPDA-----------------PSPAFHGSFTQLLVGAIGSP-----------------
Si012785m               (1330) PPDAEVAKAGFEKEG-----------------RSLPMTPQF--GQKSSP--------------------G
GRMZM5G816457_T01       (1326) GFEKHGLAVTVRPPE-----------------EEARSVPLTPQL--GQKSSP-----------------G
GRMZM5G816457_T02       (1328) GFEKHGLAVTVRPPE-----------------EEARSVPLTPQL--GQKSSP-----------------G
GRMZM2G031963_T01       (1324) GFEKHGLSAALNSPQ-----------------HEGRSLPLTPQF--GQNSSP-----------------G
LOC_Os03g33012.1        (1334) HREPSETGKENMNDRAQDGDSGAQL-------TDVSFQTEQKSSSRGGLVER-----------------
Bradi1g16120.1          (1336) --EDMVELGIPFRDI-----------------ASLTEQKPSSRGGLVER--------------------
GRMZM2G171428_T01       (1302) SEKRGEFVDLRDQVPAQSAEATLQKDISLEPNLFNANQKPNPHGGLAER--------------------
Bradi4g33370.1          (1306) HQDGLGKSKAFIDSSRE---------------ETAQLAKKFESNLFGANQKS---------------SSN
Glyma06g47880.1         (1312) HQDGLGKSKAFIDSSRE---------------ETAQLAKKFESNLFGANQKS---------------SSN
Si013374m               (1316) IEKSKTLVDSSVEETVQNTKAPLQL-------ESNLFRANQESTSHGGLAER-----------------
```

FIG. 24B

```
Bradi1g07970.1         (1218) ------------------------------LPPPPAAWAVEEVTSATAINLTP------QFS
GRMZM2G008029_T01      (1204) ------------------------------SQPPPTWGVEEVTAAPAINLVPQSFSMCFSAID
Bradi1g22680.1         (1220) --------------------------------------------------AQLHSLPP---LC
LOC_Os07g40570.1       (1198) ---------------------------------------------------------PP-PLS
Solyc03g104810.2.1     (1178) ----LAKPPTL---FPGEEENCKQGYKQNRPMNLM---VAQSPFFTIPT--------AFT
Glyma08g26230.1        (1168) AFSAAAAAADN---SGKDDDGPHKGFKQSRPMNLV---IARSPVFTVPP--------GLS
Glyma18g49830.1        (1170) FSAAAASAADN---SGKDDDGPHKGFKQSRPMNLV---IARSPVFTVPP--------GLS
POPTR_0004s12000.1     (1186) ------------EDGINCNSNLGFKPSRPTNLV---VARSPLFTVPP--------GLS
POPTR_0017s12430.1     (1188) IPNNNTNTATA---TATATSSKDDGFRQSRPMNLV---VARSPLFTVPP--------GLS
Solyc05g012770.2.1     (1174) ------------AGFTGVRPGFPPLPPPSTAAI-TQSPTAFTVPP--------GLS
AT1G13960.1            (1158) AAATASDYQRLGEGTNSSSGDVDPRFKQNRPTGLMISQSQSPSMFTVPP--------GLS
AT2G03340.1            (1156) ATAHHQTPVSSVGDGGGSGGDVDPRFKQSRPTGLMI---TQPPGMFTVPP--------GLC
POPTR_0008s09140.1     (1190) NFKPTDDKSSAGDFSRPGNLSI---VPPSPMFTMPL--------GLC
POPTR_0010s17040.1     (1192) NFKPPDDKSSAGDFSSSSSLSI---VPPPMFSMPL--------GLS
Glyma20g03410.1        (1166) -----------------------TAPSP-------MPTTTFALPP--------GFI
Glyma01g06550.1        (1160) ----------------------------------------VA--------GAV
Glyma02g12490.1        (1162) ----------------------------------------VA--------GAV
Bradi4g06690.1         (1224) QQQQQQQQER---GRGGVARAGPAISVAPP------AGAAVFTVPP--------GLS
Si021859m              (1216) QQQQREAAERG---RGGGVARAGPALSVAPPASA------SAGASVFTVPP--------GLS
GRMZM2G143765_T01      (1212) PPQQRHDAERG---RGGGVARAGPALSVAPPASA------SAGASVFTVPP--------GLS
GRMZM2G076657_T01      (1208) -PQQQHEAQT---GGGGVARAGPALSVAPPASS------FAGASLFTVPP--------GLS
GRMZM2G076657_T02      (1210) -PQQQHEAQT---GGGGVARAGPALSVAPPASS------FAGASLFTVPP--------GLS
LOC_Os03g33012.1       (1200) --------------------AASAP------APPSPFPVPH--------GLS
Bradi1g16120.1         (1222) --------------------AASSASGP------SPPSPFPVPP--------GLS
GRMZM2G171428_T01      (1206) --------------------AVPSP------PSPFAVPP--------GLS
Si035317m              (1214) --------------------AAAAAAAVP------TPPSPFSVPP--------GLS
Si0127785m             (1330) SSLAERMQARA---GFRVPKLSMPFSTAVGADNSVP---GAPSPYLTIPP--------GLS
GRMZM5G816457_T01      (1326) SSLAERMQARA---GFMVSKLNMPFSTAAGADNSVP---EVPSPYLTIPP--------GLS
GRMZM5G816457_T02      (1328) SSLAERMQARA---GFMVSKLNMPFSTAAGADNSVP---EVPSPYLTIPP--------GLS
GRMZM2G031963_T01      (1324) SSLAERMQARA---GFKVPKLNMPFSTVAGDDSSVP---GAPSPYLTIPP--------GLS
Glyma04g12830.1        (1334) ------MAARA---GFNAPRLNT---ESIRSTDLSLNPDIQSPYLTIPP--------GLS
Glyma06g47880.1        (1336) ------MAARA---GFNAPRLNT---ESIRSTDLSLNSDIQSPYLTIPP--------GLS
Bradi4g33370.1         (1302) ------MASRA---GFSIPKIDTSRVGSS---------TVIRSPIAIPP--------GLS
LOC_Os08g38990.1       (1306) GCLSERMAART---GFGVLKIDTSRVGYSTPI---------RSPVTIPP--------GVS
LOC_Os08g38990.3       (1312) GCLSERMAART---GFGVLKIDTSRVGYSTPI---------RSPVTIPP--------GVS
Si013374m              (1316) ------MAARA---GFGVLKIDTSRVSSSAPI---------RSPVTIPP--------GVS
```

FIG. 24C

```
Bradi1g07970.1       (1218) MANYA---------PPSSSSYQQNPASFASPFAAA--------ALHNPYQPPS---
GRMZM2G008029_T01    (1204) NNIYLKDHN--SMICFLSMKANYAPPPSYQYQQPTS--------FAPSPLGGRMDP---
Bradi1g22680.1       (1220) AAALL-GYP---------QDNFDMFHAQDLAQLAAQVAQKAELEETHSGELNPKITPQI
LOC_Os07g40570.1     (1198) GTAVLIGYP---------QGNFETFPQQDLVPLTAQ--------EVHSK---------
Solyc03g104810.2.1   (1178) PSGLL-NSP----GF-LSAVQSPFGMSHQQALAHVTAQ--------AALSQ---------
Glyma08g26230.1      (1168) PSGFL-NSP----GF-FSP-QSPFGMSHQQALAQVTAQ--------AVLAQ---------
Glyma18g49830.1      (1170) PSGFL-NSP----GF-FSP-QGPFGMSHQQALAQVTAQ--------AVLAQ---------
POPTR_0004s12000.1   (1186) PSGLL-DSP----AF-FSP-RSSFGMSHQQALVQVTAQA-------ALFAQ---------
POPTR_0017s12430.1   (1188) PSGLL-NSP----G--FFPPQSPFGMSHQQALAQVTAHA-------ALLAQ---------
Solyc05g012770.2.1   (1174) PTSLF-D------GF-FSPGQGPFGMSHQQVLAQLTSQ--------ASQAQ---------
AT1G13960.1          (1158) PAMLL-DSPSFLGL-FSPVQGSYGMTHQQALAQVTAQ---------AVQAN---------
AT2G03340.1          (1156) PATLL-DSPSFFGL-FSPLQTFGMTHQQALAQVTAQ----------AVQGNN--------
POPTR_0008s09140.1   (1190) PVALP-DSP----GFELFSPEG-FGMIHQQALAQVTAQ--------AAQAN---------
POPTR_0010s17040.1   (1192) PVSLP-DSP----GFGLFSPQG-FGMTHQQALAQVTAQ--------AAQAN---------
Glyma20g03410.1      (1166) D------------SPSQGQFGITHQQMLAQISSQ------------AVQ-----------
Glyma01g06550.1      (1160) ADGVM-DSP----SL-FSPSQVSFGMTHQQALTQVSAQ--------ASQAN---------
Glyma02g12490.1      (1162) APGVM-DSP----GL-FSSSQVSFGMTHQQALAQVSAQ--------ASQAN---------
Bradi4g06690.1       (1224) PSGLF-DSP----GLIFSPAMGGFGMSHQQALAQVTAQ--------ASHSP---------
Si021859m            (1216) PSGLL-DSP----GLLFSPAMGGFGMSHQQALAQVTAQ--------ATHSP---------
GRMZM2G143765_T01    (1212) PSGLF-DSP----GLLFSPAMGGFGMSHQQALAQVTAQ--------ATHSP---------
GRMZM2G076657_T01    (1208) PSGLL-DSP----GLLFSPAMGGFGMSHQQALAQVTAQ--------ATHSP---------
GRMZM2G076657_T02    (1210) PSGLL-DSP----GLLFSPAMGGFGMSHQQALAQVTAQ--------ATHSP---------
LOC_Os03g33012.1     (1200) PTAFLGGSP----GL-FSP-TGNFEMSHQQALAQVTAE--------AVHSP---------
Bradi1g16120.1       (1222) RTALL-GSP----SL-FSP-TGNFEMSHRQALAQVTAQ--------AVHSQ---------
GRMZM2G171428_T01    (1206) PATLF-GSP----GL-FSP-TGSFEMSHQQALAQVTAQ--------AVHSQ---------
Si035317m            (1214) PTALL-GSP----GL-FSP-TGSFEMSHQQALAQVTAQ--------AVHSQ---------
Si012785m            (1330) PATLL-DSP----VF-ISNGMGQTSPTTGKLFRLGGTNDNDPIRFGGSPLGAGPDSFS---
GRMZM5G816457_T01    (1326) PATLL-ESP----VF-VSNSMGQASPTTGTLFMFGSTNDNDPIRFGGGPPSVGDGPNAFP-
GRMZM5G816457_T02    (1328) PATLL-ESP----VF-VSNSMGQASPTTGTLFMFGSTNDNDPIRFGGGPPSVGDGPNAFP-
GRMZM2G031963_T01    (1324) PATLL-ESP----VF-ISNALGQASPTTGKLFLFGSTNDNDPIRPGGPPVGDGTDAFS---
Glyma04g12830.1      (1334) PTTLL-DSP----VF-LANSLAQPSPTTGKFLFMANGIMRNSELSSDAPEKCKDNGFDDIY
Glyma06g47880.1      (1336) PTTLL-DSP----VF-LANSLAQPSPTTGKFLFMVNGNMRHSELSSDAPEKCKHNGFDDIY
Bradi4g33370.1       (1302) PTTLL-ESP----VF-LYNSMAQPSPTTGKLPFFPATNANS-----TIPPAARMNEDHTFS
LOC_Os08g38990.1     (1306) PRELL-ESP----VF-LPNAIAQPSPTTGKLPFLMHSN--------VKPSIPKKTEDETRH
LOC_Os08g38990.3     (1312) PRELL-ESP----VF-LPNAIAQPSPTTGKLPFLMHSN--------VKPSIPKKTEDETRH
Si013374m            (1316) PRELL-ESP----VF-LPNAIAQPSPTTGKLPFLMPNNFKS-----MISSVPKKAEDYFHD
```

FIG. 24D

```
Bradi1g07970.1       (1218) ---TTYF----------------NHADPPPQWPPRAPSSSLPPPRGNNFALQHE
GRMZM2G008029_T01    (1204) ---YAPY----------------LHVDQPPQWPPPRATVVGSSLPHSNFTVLFP
Bradi1g22680.1       (1220) AYTKYSI----------------LDQAHNSSFSSATSA---QTSQHVSSSVIAP
LOC_Os07g40570.1     (1198) ---CITF----------------GRAENLPFIPLATSAL--VSQHTGSSSVNVT
Solyc03g104810.2.1   (1178) -----SY----------------LQTQAECHFPSQSKSVQVLGASDPEESSLQP
Glyma08g26230.1      (1168) ---SHMH----------------MQADYQMPAVTAPTE---PPVRQLSFALNEA
Glyma18g49830.1      (1170) ---SHMH----------------MQADYQMPSVTAPTE---PPVQQLSFALNEA
POPTR_0004s12000.1   (1186) ---SQMH----------------MQAQYQPSSVTAAKELL-TQYPSFNPGEALQ
POPTR_0017s12430.1   (1188) ---SQMH----------------MHAQYQPSSLTAPTELL-TRHPSFNPGEALQ
Solyc05g012770.2.1   (1174) ---SQMII---------------IQPNYPSSATAAALS---MSQFQSLFSNAA
AT1G13960.1          (1158) ---ANMQ----------------PQTEYPPPSQVQSFS---SGQAQIPTSAPLP
AT2G03340.1          (1156) -----------------------VHMQQSQQSEYPSSTQQQQQQQQASLTEIP
POPTR_0008s09140.1   (1190) ---SNMH----------------VQQEYSTSAMSST----QFL-SINNSAAQQ
POPTR_0010s17040.1   (1192) ---SIMH----------------VQPEYSTPAMSSTFTSTQGAHQQQQKVRSVA
Glyma20g03410.1      (1166) -----------------------THSEHP----------FSISAVSATSSCA
Glyma01g06550.1      (1160) -----------------------IQAEHSL----------TQASAATFN
Glyma02g12490.1      (1162) ---SNMH----------------IQAEHSLTQAPAAAS----------N
Bradi4g06690.1       (1224) ---LRMF----------------DHIEQPSFSAAASSS---EAVQHMSSAANMA
Si021859m            (1216) ---LRMF----------------DHIEQPSFSAAAASS---GALQHMNSSANMT
GRMZM2G143765_T01    (1212) ---LRMF----------------DHLEQPSFSTAATMS---GALQHMNSAASMA
GRMZM2G076657_T01    (1208) ---LRMF----------------DHLEQPSFSTAATTS---GALHHMNSAASMA
GRMZM2G076657_T02    (1210) ---LRMF----------------DHLEQPSFSTAATTS---GALHHMNSAASMA
LOC_Os03g33012.1     (1200) ---YSMI----------------NQSDFSLPFSSTTTSV--LASQHVNSSANVS
Bradi1g16120.1       (1222) ---YTIV----------------NQADYPLPFSSTTSA---FTSQHVNSSANIT
GRMZM2G171428_T01    (1206) ---YNMI----------------NHTDYSIPFSSTTAPAL-ITAQHANSSANVA
Si035317m            (1214) ---YNMI----------------NNSDYSIPFSSTTKPAANVKLQHVN-PANVT
Si012785m            (1330) ---FKPLDLKSSLYTAEGKKPPLPSTHVSVKTETKIQPVQEANLLGKLNQONQSGQTNLK
GRMZM5G816457_T01    (1326) ---FKPLDLKSSHYTAEA-----MKEQNTKSSVKTETKILTVQEASLLSQLNQL
GRMZM5G816457_T02    (1328) ---FKPLDLKSSHYTAEA-----MKEQNTKSSVKTETKILTVQEASLLSQLNQL
GRMZM2G031963_T01    (1324) ---FKPLDLKSSHYTAEVMKEQNTQSS--VKTEAKTQAVQEANLLGQLNQQNHDGQTNMN
Glyma04g12830.1      (1334) TSSFAFKRAIDSG-SFYHGAGRKMINPTTLPQQSLPGIEVSAQSENSFQSQSVDAVKAQT
Glyma06g47880.1      (1336) TSSFAFKPAIDSGSSFYHGAGRKINPTT-LPQQSLPGVEVSAQSENSFQCQSVDAVKAQT
Bradi4g33370.1       (1302) NDVFSFQPHLGSKAPSL------STVEKGYNACPSNQSLSNIHQRESNLQSSFT
LOC_Os08g38990.1     (1306) DRVFFFQPILGSKPPTC------PVAEKGFSVNHQNQPSVTDNHQELSLQSSST
LOC_Os08g38990.3     (1312) DRVFFFQPILGSKPPTC------PVAEKGFSVNHQNQPSVTDNHQELSLQSSST
Si013374m            (1316) DCAFSFQPILMSKPPSF------STVDKGLSAVHQNQSLA-NYSQELSLQANTT
```

FIG. 24E

```
Bradi1g07970.1        (1218) QQQQQQQSMQ-------------------------------MQLLRALGRPHQALASAPA-----
GRMZM2G008029_T01     (1204) SNPYEHDMQ------LRAT-------ALFGGGGSYSYT-LPPPP----
Bradi1g22680.1        (1220) SMWCIP-TL------PSHTEC-----IKTESNRVSQ----VLQGA---
LOC_Os07g40570.1      (1198) PLQEILTS-------PSQISN-----VNTESIGVLQ----GLPAS---
Solyc03g104810.2.1    (1178) QLDTM----------SSDQKS-----KKFELPQLSQS---EDKPS---
Glyma08g26230.1       (1168) SEQQVVSCV------SSVSEPRN---AQLEAPELSQADK-KYQPS---
Glyma18g49830.1       (1170) SEQQVVSCV------SEPRN------AQLEAPELSQADK-KYQPS---
POPTR_0004s12000.1    (1186) QQQLMPPST------SDAQN------SMVEPAEFSHSER-KYQPP---
POPTR_0017s12430.1    (1188) QQQQMPHST------SDTQN------SVVELTEFSHSER-KYQPP---
Solyc05g012770.2.1    (1174) ANRQIP---------PTLDPN-----IVKESSDVSLSDQ-RSEPA---
AT1G13960.1           (1158) AQRETSDV-------------TIIEH------RSQQP---
AT2G03340.1           (1156) SFSSAPRSQ------IRASVQE----TSQGRETSEISVFEHRSQ----
POPTR_0008s09140.1    (1190) QQQQMAGS-------VTDSRV-----TVQELSGIPHADRIRSESS---
POPTR_0010s17040.1    (1192) DSRVKIQEL-----------------SDFSRSDQ------RSESS---
Glyma20g03410.1       (1166) AQQLIP---------PSMPDS-----KVKESLDYSHSEQ-KLQSS---
Glyma01g06550.1       (1160) TTQQLIPPL------NADSWA-----TMTESADHSHSEQ-RLQSS---
Glyma02g12490.1       (1162) TTQQLMPPL------TSDSWA-----AMTESIDHSHSEQ-RLQSS---
Bradi4g06690.1        (1224) GMSEMAT--------ISNNDN-----AAFHSAEASQ----RYQVP---
Si021859m             (1216) GMPEMA-IT------TANNDN-----ASFQSAEPSQ----RYQVN---
GRMZM2G143765_T01     (1212) GISDMT-MA------TANNEN-----TSFQSAEASQ----RYQVN---
GRMZM2G076657_T01     (1208) GISDMT-MA------TANNEN-----PSFQSAEASQ----RYQVN---
GRMZM2G076657_T02     (1210) GISDMT-MA------TANNEN-----PSFQSAEASQ----RYQVN---
LOC_Os03g33012.1      (1200) SPREIPTL-------PSHTDN-----SNIESTEVSH----GFQTT---
Bradi1g16120.1        (1222) STEETPTP-------PSLIGN-----SNFKPNEVSQ----GFQTS---
GRMZM2G171428_T01     (1206) SAQEKPAL-------PSHAGN-----SNIESNEVSQ----GFQTS---
Si035317m             (1214) STQEISTL-------PSHTGN-----NNIEPNEVSQ----GLQNS---
Si012785m             (1330) SGSHDSKLLSRLAPVTGAGNEHV---SSPHGQPMEEGDARGGDYT---
GRMZM5G816457_T01     (1326) NHNSQTIINSGGPHDPKLSRPASGAGAGNEHISPPDHGQTAEESDAREDYP
GRMZM5G816457_T02     (1328) NHNSQTIINSGGPHDPKLSRPASGAGAGNEHISPPDHGQTAEESDAREDYP
GRMZM2G031963_T01     (1324) SDGARDSKL------SRLASGTGAGNEHASPPDYGQRAEEADA--REDYP
Glyma04g12830.1       (1334) ENKSGFRLQADFAESPPQKDNGIKMFSADQRAFDVVGGGNEHSTPIEEQVDEGDQRGNGD
Glyma06g47880.1       (1336) ENKSGLHLQEDFVESPPQKDNGIKMFSANQRAFHAVGSGIEHSTPVEEQADEEGDQRVNG
Bradi4g33370.1        (1302) AVKDTADET------IIKPKTSDSMFGDDH--SSSEEQEDDETDQ-NGEYS
LOC_Os08g38990.1      (1306) AAKDFTSAT------IVKPKTSDSMLDNDDHPSPANDQEENATNK---NEEYS
LOC_Os08g38990.3      (1312) AAKDFTSAT------IVKPKTSDSMLDNDDHPSPANDQEENATNK---NEEYS
Si013374m             (1316) ATKDETEEN------LVKPSTCDS-MLDNDHPSPADEQEESEENQ---NEEDS
```

FIG. 24F

FIG. 24G

```
Bradi1g07970.1      (1218) YKGRHTHPRPPHQPRRGGDNVADAGSGADAEEEEE---------------
GRMZM2G008029_T01   (1204) YKGRHNHPRPQEGGLAGGNDAGLA--AAEEDAEGP---------------
Bradi1g22680.1      (1220) YRGQHSHPRP--SKRYKDCGILL----KESDDFNDT--------------
LOC_Os07g40570.1    (1198) YRGQHTHPRP-SKRRFKDCGGIS----DDLDDFSGT--------------
Solyc03g104810.2.1  (1178) YKGHHNHHLPQPNKRRRDSCAQDGSDCSNINPETGT--------------
Glyma08g26230.1     (1168) YKGQHNHHKPQANRRAKDNSDSN----GNVTVQPKS--------------
Glyma18g49830.1     (1170) YKGQHNHHKPQANRRAKDNSDSN----GNVTVQPKS--------------
POPTR_0004s12000.1  (1186) YKGQHNHDQL--NKLSKDGDDSN----GSIHSQSKP--------------
POPTR_0017s12430.1  (1188) YKGQHNHDLPQPNKRSKDCNDSN----GSIHLQSKP--------------
Solyc05g012770.2.1  (1174) YKGQHNHPPQASKRSKESGNPN-----GNYNLQGPY--------------
AT1G13960.1         (1158) YKGQHNHEPPQNTKRGNKDNTANINGSSINNNRGSS--------------
AT2G03340.1         (1156) YKGQHNHELP--QKRGNNNGSC-----KSSDIANQF--------------
POPTR_0008s09140.1  (1190) YKGQHNHEPPQPNKRGKEGIN------GNSNSQGNF--------------
POPTR_0010s17040.1  (1192) YKGQHNHOPPQSNKRGKDTGGLN----GNSNSHGNS--------------
Glyma20g03410.1     (1166) YKGEHNHORPHRSKIVKETQTSNENSVSKMDLGSSQ--------------
Glyma01g06550.1     (1160) YKGEHNHORPHPNKRSKDTMTSN----ANSNIQGSV--------------
Glyma02g12490.1     (1162) YKGEHNHOCPHPNKCSKDTMTSN----ENSNMQGNV--------------
Bradi4g06690.1      (1224) YKGKHNHORP-PNKRAKDGNS------SAAEHNEQS--------------
Si021859m           (1216) YKGKHNHORP-PNKRAKDGNS------SAADQNEQS--------------
GRMZM2G143765_T01   (1212) YKGKHNHORP-PNKRAKDCNS------SAADHNEQS--------------
CRMZM2C076657_T01   (1208) YKGKHNHORP-PNKRAKDGNS------SAFDQNEQS--------------
GRMZM2G076657_T02   (1210) YKGKHNHORP-PNKRAKDGNS------SAFDQNEQS--------------
LOC_Os03g33012.1    (1200) YRGQHNHORP-PKRRSKDGALL-----NEADVSPEK--------------
Bradi1g16120.1      (1222) YRGQHNHORP-PKRRSKDGGSLL----DEVDDFHEN--------------
GRMZM2G171428_T01   (1206) YRGQHNHORP-PKRRSKDGGGPL----NEADVLHEN--------------
Si035317m           (1214) YRGQHNHORP-PKRRSKDGGGLL----NEADDFHEN--------------
Si012785m           (1330) YKGTHNHPKPTQSRRPGVPPLHPFGDGAQAEAPDNQ-------GSHSNVA
GRMZM5G816457_T01   (1326) YKGAHNHPKPTQSRRPGVQPVHPFGDSAQADAADNL--------------
GRMZM5G816457_T02   (1328) YKGAHNHPKPTQSRRPGVQPVHPFGDSAQADAADNL--------------
GRMZM2G031963_T01   (1324) YKGTHNHPKPTQSRRPGAGAHPLGGG-AQADAADNL--------------
Glyma04g12830.1     (1334) YKGTHNHPKPPPNRRSGIGLVNLHTD-MQVDHPEHVEPHNGGDGLGWANVQKGNIAGAA
Glyma06g47880.1     (1336) YKGTHDHAKPPPNRRSSIGSVNLHTD-MQVDNPEHVEPHNGGDGLGWANVQKGNIAGAA
Bradi4g33370.1      (1302) YKGTHNHPLPPLNPHSGVPLSHISDPQVNARKNPGL--------------
LOC_Os08g38990.1    (1306) YKGSHNHPLPPSNRRPNVPFSHF----NDLRDDHSE------------KF
LOC_Os08g38990.3    (1312) YKGSHNHPLPPSNRRPNVPFSHF----NDLRDDHSE--------------
Si013374m           (1316) YKGSHSHPLPPPNRRPSVPSSHV----NDLQADGSE------------KF
Consensus           (1299) YXGxHxH
```

FIG. 24H

```
Bradi1g07970.1       (1218) ------------------------------------------------------HGD
GRMZM2G008029_T01    (1204) --------------------------------------------------------
Bradi1g22680.1       (1220) ---------------------------------------VTSIGTMADYS-LPMREGGDE
LOC_Os07g40570.1     (1198) -----EDASTKSQLDCLGYDGKP-----------------IIPSGTMVAPL-VKKIEDGDD
Solyc03g104810.2.1   (1178) -----TGTSVRSQPDYDYCRKP------------------ST----------------E
Glyma08g26230.1      (1168) -----HTELEINGLNGALVAHSEQV--------PDSSVAKSDQT-SNQGAPPRQ
Glyma18g49830.1      (1170) -----ESNSQGWVGQLNKFSEKI----------PDSSVAKSDQT-SNQGAPPRQ
POPTR_0004s12000.1   (1186) -----ESNSQGWVGQLNKLSENI----------PNSSVPESDQT--SNQGAPRQ
POPTR_0017s12430.1   (1188) -------EVVSQAHADPSEPP--------------------------------
Solyc05g012770.2.1   (1174) -----EVGSQAQAGNAIKLTETL----------PAHSVIGRDQE-STQADPSEP
AT1G13960.1          (1158) -----ELSSEGLTGNYNKPKEGE----------PSYSLRMKDQ----ESSQAND
AT2G03340.1          (1156) -----ELGASQFQTNSSNKTKRE----------QHEAVSQATT--------E
POPTR_0008s09140.1   (1190) -----QTSNSSLNKSKRDQETSQ----------VTTT--------------E
POPTR_0010s17040.1   (1192) -----EMATLQSGYVRKTRDRK-----------DQESSQ----------ATPE
Glyma20g03410.1      (1166) -----ELDSRFQSGNVSKERDRK----------DQESSQ----------ATPE
Glyma01g06550.1      (1160) -----DSTYQGTTNSMSKMDPE------------------ATGE
Glyma02g12490.1      (1162) -----DSTYQGTSTNSMSKMDPE--------SSQ---------------ATAD
Bradi4g06690.1       (1224) -----NDTASGLSGVRRDQEAVY---------SSQATAD
Si021859m            (1216) -----NDTTSGLSGAKRDQDAIY----------AMS--------E
GRMZM2G143765_T01    (1212) -----NDTASGLSAAKRDQDNIY----------GMS--------E
GRMZM2G076657_T01    (1208) -----NDTTSGLSGAKRDQDNIY----------GMS--------E
GRMZM2G076657_T02    (1210) -----NDTTSGLSGAKRDQDNIY----------GMS--------E
LOC_Os03g33012.1     (1200) -----EDASTRSEQGSQDYSGKF-----KASNDG--GPS-SSRRGDRGE
Bradi1g16120.1       (1222) -----GDTLNRSEQGSQDHSAKF-----EVSNDGITVPS-MSKRAEGDD
GRMZM2G171428_T01    (1206) -----EDISTRSEPGSQEHSGKH-----EGSNDGILGPS-VSRRGGGDE
Si035317m            (1214) -----EDASTRSEPGSQDHSGKH-----GGSNDGLAGPS-VSRRREGDE
Si012785m            (1330) GARLNNAGIEDLHGDGTDATSPP-----SVPGELCDSSASMQIHDAGGLD
GRMZM5G816457_T01    (1326) -----GSQANALDANQPRRAGVQDGMDATSSPSVPIERCDSPASMQVDSA-TRFGSPEGA
GRMZM5G816457_T02    (1328) -----GSQANALDANQPRRAGVQDGMDATSSPSVPIERCDSPASMQVDSA-TRFGSPEGA
GRMZM2G031963_T01    (1324) -----QGSQANAAEANQAWRAGVQDGVDATSPPSVPGELCDSAASMQVDCAARFGSPEGAD
Glyma04g12830.1      (1334) SWKHDNLEAASSASVGPEYCNQQ---------PPNLQTQNGTH--FDSGEAVD
Glyma06g47880.1      (1336) NWKHENIEATSSASVGPEYCNQS---------PNLQAQNGTHL----DSGE
Bradi4g33370.1       (1302) -----QAGLDSASLWENGRSGCIQDV-------QSEGVDARPGTRLPVSAYGDT
LOC_Os08g38990.1     (1306) -----GSKSGQATATSWENAANGHLQDV-----GSEVLTKLSAS-LTTEHAEK
LOC_Os08g38990.3     (1312) -----GSKSGQATATSWENAANGHLQDV-----GSEVLTKLSAS-LTTEHAEK
Si013374m            (1316) -----NFCSKPVKFLKRNLSGSL----------TTTEIADTC---VMESQEAVD

FIG. 24I
```

| | | | |
|---|---|---|---|
| Bradi1g07797C.1 | (1218) | QLP------------SDDEDNGQEG------QDRTAGGGA------------------ |
| GRMZM2G008029_T01 | (1204) | ---------------SDDDDDASMH------EDDVEGAPGMGADG-------------- |
| Bradi1g22268C.1 | (1220) | KVSGTSD--------YRGEGDDETR------TADEAVGDTDANER-------------- |
| LOC_Os07g40570.1 | (1198) | QLSGSSD--------NQDEHDDEVR------TSDGASGDASANER-NV----------- |
| Solyc03g104810.2.1 | (1178) | MACERSV--------SNECEDAETA------ASKEHDDEPNVKRM----------KTTV |
| Glyma08g26230.1 | (1168) | LLPGSSE--------SEEVGDVDNR------EEADDGEPNPKRR-NT---------DVGV |
| Glyma18g49830.1 | (1170) | LLPGSNE--------SEEVGIVDNR------EEADDGEPNPKRR-NT---------DVGV |
| POPTR_0004s12000.1 | (1186) | ---GSSD--------NEEAGNAAVQ------EEERGDDEPIPKRR-QVWDVSLQIDVVTS |
| POPTR_0017s12430.1 | (1188) | --PGPSD--------SEEAGDAAVQ------EEERGDDEPNPKRR-QC--------RQVDVVT |
| Solyc05g012770.2.1 | (1174) | QTSGSSD--------SEEVGNAETR------VDGRDIDERESKRR-AV---------EVHS |
| AT1G13960.1 | (1158) | HLSEASD--------GEEVGNGETD------VREKDENEPDPKRR-ST---------EVRI |
| AT2G03340.1 | (1156) | QMSEASD--------SEEVGNAETS------VGERHEDEPDPKRR-NT---------EVRV |
| POPTR_0008sC9140.1 | (1190) | HVSGMSD--------SEEVSDTETG------GRIDEDEPGHKRRITT---------EVRV |
| POPTR_0010s17040.1 | (1192) | HISGMSD--------SEEVGDTEAG------GE-VDEDEPDPKRR-ST---------EVRV |
| Glyma20g03410.1 | (1166) | HGSGTSD--------SEEVDDHETE------ADEKNDEPDAKRR-NT----------EARI |
| Glyma01g06550.1 | (1160) | HLSGTSE--------SEEVGDHETE------VDEKNVEPDPKRR-KA----------EVSQ |
| Glyma02g12490.1 | (1162) | RLSGTSD--------SEEVADHETE------VDEKNVEPEPKRR-KA----------EVSQ |
| Bradi4g06669C.1 | (1224) | QLSGLSD--------GDDKDDGESR------PNEVDNGENDCKRR-NI---------- |
| Si021859m | (1216) | QVSGLSD--------GDDMDDGESR------PHEVDDADNESKRR-NI---------- |
| GRMZM2G143765_T01 | (1212) | QASGLSD--------GDDMDDGESR------PHEVDDADNESKRR-NI---------- |
| GRMZM2G076657_T01 | (1208) | QAYGLSD--------GDDMDDGESR------PHEVDDADNESKRR-NI---------- |
| GRMZM2G076657_T02 | (1210) | QAYGLSD--------GDDMDDGESR------PHEVDDADNESKRR-NI---------- |
| LOC_Os03g33C12.1 | (1200) | QISGSSD--------SNDQGEEEVK------VEGRATSDGNANKR-HV---------- |
| Bradi1g16l2C.1 | (1222) | QSSGSSD--------SEEKACDEAG------ADNGDGGSTNAKKR-HV---------- |
| GRMZM2G171428_T01 | (1206) | QLSGSSD--------SDEEQDDEQR------AGDEDPGYANANKR-HV---------- |
| Si035317m | (1214) | QLSGSSD--------SEEEADDEQR------VGNGDAGRANANRR-HV---------- |
| Si012785m | (1330) | VTSAVSD--------EVDGGDRVTHGSLSQGGADAEGDELESKRR-KL---------ESYT |
| GRMZM5G816457_T01 | (1326) | DVTSVSD--------EVGGDDRVTRGSMSQGGADAEGDELECKRR-KL---------ESYA |
| GRMZM5G816457_T02 | (1328) | DVTSVSD--------EVGGDDRVTRGSMSQGGADAEGDELECKRR-KL---------ESYA |
| GRMZM2G031963_T01 | (1324) | VTSAVSD--------EVDGDDRVTL--THGGANAAEGDELESKRRADRLSGYFRKLESYA |
| Glyma04g12830.1 | (1334) | ASSTFSN--------EEDEDDQGTH-GSVSLGYDGEGESESKRR-KL---------ESYA |
| Glyma06g47880.1 | (1336) | AVDASSTF-------SNEEDDQVTH-GSVSLGYDGEGESESKRR-KL---------ESYA |
| Bradi4g33337C.1 | (1302) | SIVESQDAVDVSSTLSNEEIDRATH-GTVSLDCDGGEDETESKRR-KLDALATATVTAAA |
| LOC_Os08g38990.1 | (1306) | SVMDKQEAVDISSTLSNEEDDRVTHRAPLSLGFDANDDYVEHKRR-KM-DVYAATSTSTN |
| LOC_Os08g38990.3 | (1312) | SVMDKQEAVDISSTLSNEEDDRVTHRAPLSLGFDANDDYVEHKRR-KM-DVYAATSTSTN |
| Si013374m | (1316) | SNEKDERATQ-CTIPSTYRGDDETESKRR-KMEVSAAANTTNA |

FIG. 24J

FIG. 24K

```
Bradi1g07970.1      (1218) TAENCNVRKQIERASSNPSCVLTTYTGRHSH--PPGRA------------TGGSSAVPTPS
GRMZM2G008029_T01   (1204) TADNCNVRKQIERATTDPRCVLTTYTGRHNHDPHPPGRG-NEA------AAGGSSADPAPS
Bradi1g22680.1      (1220) TYQGCDVKKHIERSSQEPHAVITTYEGKHVHDV-PGSRN-RSH---------AAGQPYCT
LOC_Os07g40570.1    (1198) TYLGCDVKKQVERSVEEPNAVITTYEGKHIHDV-PAARN-KSH------VVANASLLQNTK
Solyc03g104810.2.1  (1178) TYPGCNVRKHVERASADPKAVITTYEGKHNHDI-PIARN-RSH------STAQNSSRQLNE
Glyma08g26230.1     (1168) TSAGCNVRKHVERASMDPKAVITTYEGKHNHDV-PAARN-SSH------NTASSNSMPLKP
Glyma18g49830.1     (1170) TSAGCNVRKHVERASTDPKAVITTYEGKHNHDV-PAARN-SSH------NTASSNSMPLKP
POPTR_0004s12000.1  (1186) TSAGCNVRKHVERAAADPKAVITTYEGKHNHDV-PAARN-SSH------NTANTNAAPLKP
POPTR_0017s12430.1  (1188) TSAGCNVRKHVERAAADPKAVVTTYEGKHNHDV-PAARN-SSH------NTANTSASQVKP
Solyc05g012770.2.1  (1174) TSQGCNVRKHVERAASDPKAVITTYEGKHNHDV-PAARN-SSH------NTANNSMSQLRP
AT1G13960.1         (1158) TTPGCGVRKHVERAATDPKAVVTTYEGKHNHDL-PAAKS-SSH----AAAAAQLRPDNR
AT2G03410.1         (1156) TTPDCGVRKHVERAATDPKAVVTTYEGKHNHDV-PAART-SSH-----------QLRPNNQ
POPTR_0008s09140.1  (1190) TTPGCKVRKHVERAAADPRAVITAYEGKHNHDV-PAAKN-SSH------ITVNSNASQLKP
POPTR_0010s17040.1  (1192) TTAGCKVRKHVERAAADPKAVITTYEGKHNHDV-PAAKN-SSH------NTVNSNASQLKP
Glyma20g03410.1     (1166) TTQGCKVRKHVERASMDPKAVITTYEGKHNHDV-PAAKT-NSH------TLANNSASQLKA
Glyma01g06550.1     (1160) TTQGCNVRKHVERASTDPKAVITTYEGKHNHDV-PAAKN-NSH------TMASNTASQLKS
Glyma02g12490.1     (1162) TTQGCNVRKHVERASTDPKAVITTYEGKHNHDV-PAAKT-NSH------TMASNTASQLKS
Bradi4g06690.1      (1224) TFAGCNVRKHIERASSDPKAVITTYEGKHNHEP-PVGRGSNQN------AGNSAPSNRSQQ
Si021859m           (1216) TFAGCNVRKHIERASSDPKAVITTYEGKHNHEP-PVGRG-SNQ-----------NAGVSQQ
GRMZM2G143765_T01   (1212) TFAGCNVRKHIERCSSDPKAVITTYEGKHNFEP-PVGRG-GNQ-----------NAGMSSQQ
GRMZM2G076657_T01   (1208) TFAGCNVRKHIERASSDPKAVITTYEGKHDHEP-PVGRG-NNQ-----------NAGIPQQK
GRMZM2G076657_T02   (1210) TFAGCNVRKHIERASSDPRAVITTYEGKHDHEP-PVGRG-NNQ-----------NAGIPQQK
LOC_Os03g33012.1    (1200) TYQGCDVKKHIERSSQDPKAVITTYEGKHSHDV-PAARN-SSHSSANANVSSSSNLPHKD
Bradi1g16120.1      (1222) TFQGCDVKKHIERCSQDSTDVITTYEGKHSHDV-PAARN-SSH---ASNANASSSSSLRH
GRMZM2G171428_T01   (1206) TYQGCDVKKHIERSSQDPKAVITTYEGKHSHDV-PAVRN-GSH------AAANANGSSSTS
Si035317m           (1214) TYQGCDVKKHIERSSQDPKAVITTYEGKHSHDV-PAARN-SSH------AAAAAANANASS
Si012785m           (1330) THPGCSVRKHVERASHDLKSVITTYEGKHNHEV-PAARN-SGH-----PSTATATGAAAA
GRMZM5G816457_T01   (1326) TYPGCVVRKHVERASHDLKSVITTYEGRHNHEV-PAARN-SGH------PGTAAATGAGGP
GRMZM5G816457_T02   (1328) TYPGCVVRKHVERASHDLKSVITTYEGRHNHEV-PAARN-SGH------PGTAAATGAGGP
GRMZM2G031963_T01   (1324) TQPGCTVRKHVERASHDLKAVITTYEGKHNHEV-PAARN-SGH------PSAAAAPGAGGP
Glyma04g12830.1     (1334) TNAGCTVRKHVERASHDLKSVITTYEGKHNHDV-PAARA-SSH------VNANASNAVPGQ
Glyma06g47880.1     (1336) TNAGCTVRKHVERASHDLKSVITTYEGKHNHDV-PAARA-SSH------VNANASNAVPGQ
Bradi4g33370.1      (1302) THPGCSVRKHVERASHDLKSVITTYEGKHNHDV-PAARA-SGH------ASSGSGSAPASM
LOC_Os08g38990.1    (1306) THPGCSVRKHVERSSHDLKSVITTYEGKHNHEV-PAARN-SGH------PSSGSAAAPQAT
LOC_Os08g38990.3    (1312) THPGCSVRKHVERSSHDLKSVITTYEGKHNHEV-PAARN-SGH------PSSGSAAAPQAT
Si013374m           (1316) TYAGCTVRKHVERASNDLKSVITTYEGKHNHEV-PAARN-SGH------PSSGSAAAPQAT
Consensus           (1300) TxxxCxVxKxxxERxxxxVxTxYxGxHxHxxxPxxX
```

FIG. 24L

```
Bradi1g07970.1          (1218)  TAIGNTARQLKEESRD-------------------------------------------------------------
GRMZM2G008029_T01       (1204)  SANTATGTGGSAADGGVL--------------------------------------------------AGK----
Bradi1g22680.1          (1220)  EQTYSEQSSASFCSRSEK-----------------------------------------------GKYSA
LOC_Os07g40570.1        (1198)  SNTYCTEQSYTTITC--------------------------------------------------------
Solyc03g104810.2.1      (1178)  QEIATW--RPAILEKVAL-----------------------------------------------HTSEI
Glyma08g26230.1         (1168)  HNVVPE--KHPLLKDMDF-----------------------------------------------GSTDQ
Glyma18g49830.1         (1170)  HNVVPE--KHPLLKDKDF-----------------------------------------------GGNDQ
POPTR_0004s12000.1      (1186)  QKVVAE--KHPMLKGMDF-----------------------------------------------GNNNQ
POPTR_0017s12430.1      (1188)  QKVVTE--KHPLHKGMEF-----------------------------------------------GNNDQ
Solyc05g012770.2.1      (1174)  HNPVVD--RPAAMRRADF-----------------------------------------------QSNEQ
AT1G13960.1             (1158)  PGGLANLN---------------------------------------------------------QQQQQ
AT2G03340.1             (1156)  HNTSTV-----------------------------------------------------------NFNHQ
POPTR_0008s09140.1      (1190)  QTLEKRASN--------------------------------------------------------NSNNQ
POPTR_0010s17040.1      (1192)  QTLEKHAS---------------------------------------------------------NNSNS
Glyma20g03410.1         (1166)  QKFAIPDVKHSSSSRGV------------------------------------------------TGNEQ
Glyma01g06550.1         (1160)  HNTNPE--KHNFGSRGM------------------------------------------------GGNEQ
Glyma02g12490.1         (1162)  HNTNPE--KHNFGSRGM------------------------------------------------GGNEQ
Bradi4g06690.1          (1224)  KGPSSMSSNQTSLTRTDF-----------------------------------------------SNNNQ
Si021859m               (1216)  RGQNSISSNQASLSIADY-----------------------------------------------SITNQ
GRMZM2G143765_T01       (1212)  KGQNNVSSNQASFSRPDL-----------------------------------------------SNANQ
GRMZM2G076657_T01       (1208)  EGQNNISSNQASLSRPDF-----------------------------------------------SNANQ
GRMZM2G076657_T02       (1210)  EGQNNISSNQASLFEARF-----------------------------------------------------
LOC_Os03g33012.1        (1200)  RGQRSSCRD--------------------------------------------------------GLRNA
Bradi1g16120.1          (1222)  RAQNTASSSQPSLRRS-------------------------------------------------ALRTA
GRMZM2G171428_T01       (1206)  LPVPHRVHSSASSSRRAA-----------------------------------------------ELQSA
Si035317m               (1214)  SSSLPHKGQNSASSSR-------------------------------------------------KRADM
Si012785m               (1330)  RRPEHPSAHDGLM-RHLG-SCGAPFAL---PLPSRDPLAPMVNYPAYASAALGGSGGSGL
GRMZM5G816457_T01       (1326)  RRLEHPSLRDGLM-GHLG-GCGVPFGL----PPPRDPLAPMGNYPTYASSIPL--GGAGP
GRMZM5G816457_T02       (1328)  RRLEHPSLRDGLM-GHLG-GCGVPFGL----PPPRDPLAPMGNYPTYASSIPL--GGAGP
GRMZM2G031963_T01       (1324)  RRQEHPSVHDGLMRQHLG-GCGVPFGLPPPPPPRDPLAPMRNYPTYGFTALGA-GSTSL
Glyma04g12830.1         (1334)  ASLQTHVHRPEPSEVHNGIGRLERPSLGSFNLPGRQQLGPS-HGFSFGMNQS--MLSNL
Glyma06g47880.1         (1336)  ASLQTHVHRPEPSQVHNGIGRLERPSLGSFNLPGRQQLGPS-HGFSFGMNQS--MLSNL
Bradi4g33370.1          (1302)  PQVNLSHRRQEQAQGSFG-QFGGSTPFGSFGLPPRGQLGAA-GNFRFGMVPP---GMSIP
LOC_Os08g38990.1        (1306)  NGLLHR--RPEPAQGGGG-GSLAQFGYGSAGHRPAEQFGAAAAGFSFGMLPR---SIATP
LOC_Os08g38990.3        (1312)  NGLLHR--RPEPAQGGGG-GSLAQFGYGSAGHRPAEQFGAAAAGFSFGMLPR---SIATP
Si013374m               (1316)  N----LHRRPEPAQPSIP-QLNAAAAYGSLGLPP--QLSAASGGFSFGLLPP---GMAVP
```

FIG. 24M

```
Bradi1g07970.1         (1218) -------------------------------------------------------------------
GRMZM2G008029_T01      (1204) -------------------------------------------------------------------
Bradi1g22680.1         (1220) VSLKHVAF-----------------------------------------------------------
LOC_Os07g40570.1       (1198) -------------------------------------------------------------------
Solyc03g104810.2.1     (1178) QV-----------------------------------------------------------------
Glyma08g26230.1        (1168) RPV-HLRLKEEQIIV----------------------------------------------------
Glyma18g49830.1        (1170) RPV-HLRLKEEQIIV----------------------------------------------------
POPTR_0004s12000.1     (1186) RPL-LLQLKEEKIAV----------------------------------------------------
POPTR_0017s12430.1     (1188) RPV-LLQLKEEKIAV----------------------------------------------------
Solyc05g012770.2.1     (1174) QPIALLRFKEEQSI-----------------------------------------------------
AT1G13960.1            (1158) QPVARLRLKEEQTT-----------------------------------------------------
AT2G03340.1            (1156) QPVARLRLKEEQIT-----------------------------------------------------
POPTR_0008s09140.1     (1190) QPIARLRLK----------------------------------------------------------
POPTR_0010s17040.1     (1192) QPAARLRLKEEQIT-----------------------------------------------------
Glyma20g03410.1        (1166) RPVASLRLKEEQIT-----------------------------------------------------
Glyma01g06550.1        (1160) QPVARLRLKEEQIT-----------------------------------------------------
Glyma02g12490.1        (1162) QPVARLQLKEEQIT-----------------------------------------------------
Bradi4g06690.1         (1224) RPIGVLQFKREE-------------------------------------------------------
Si021859m              (1216) RPIGLLQFKSEQ-------------------------------------------------------
GRMZM2G143765_T01      (1212) MPIGILQFKSEQ-------------------------------------------------------
GRMZM2G076657_T01      (1208) MPIGILQFKSEQ-------------------------------------------------------
GRMZM2G076657_T02      (1210) -------------------------------------------------------------------
LOC_Os03g33012.1       (1200) SSVSSLQLKEESG------------------------------------------------------
Bradi1g16120.1         (1222) SSDSSLQLKEENEIT----------------------------------------------------
GRMZM2G171428_T01      (1206) SSASSMLLKEENEIT----------------------------------------------------
Si035317m              (1214) SSASSMLLKEENEIT----------------------------------------------------
Si012785m              (1330) LPSLLMPGGGPLGQVEGLKLPMLAQSSLQQQHPLLRHRQAMQAAGLVAPKAADVKVE----------
GRMZM5G816457_T01      (1326) TSLPSLPVPAGTLSAVDGLKLPMLAPSSLQQHPLLRHRQAMQAAGLVAPKDDVKVE-----------
GRMZM5G816457_T02      (1328) TSLPSLPVPAGTLSAVDGLKLPMLAPSSLQQHPLLRHRQAMQAAGLVAPKDDVKVE-----------
GRMZM2G031963_T01      (1324) PSLPMLPVLAPSSLHQHPLLRHRQAVQAAGLAWRPRPT-----------------------------
Glyma04g12830.1        (1334) VMSGLGHAQAKLPVMPVHSFLAAHQQQQHQQQQNQQQRAANDLGFMLPK-GEPNVEAIP--------
Glyma06g47880.1        (1336) VMSGLGHAQAKLPVMP------------------------------------GEPNVEAIP-----
Bradi4g33370.1         (1302) MPAAH-------QQ------------------------------SMMQGYPGLMMPE-GQPKTEPGP
LOC_Os08g38990.1       (1306) APSPAIAVPAMQGYP---------------------------------------GLVLPRGEM---
LOC_Os08g38990.3       (1312) APSPAIAVPAMQGYP---------------------------------------GLVLPRGEM---
Si013374m              (1316) VPSLGTFMPAPIPGHP--------------------------------------PTMQGCTGLVVPR-GEVKVNLEE
```

FIG. 24N

| | | |
|---|---|---|
| Bradi1g07970.1 | (1218) | ------------------------------- |
| GRMZM2G008029_T01 | (1204) | ------------------------------- |
| Bradi1g22680.1 | (1220) | ------------------------------- |
| LOC_Os07g40570.1 | (1198) | ------------------------------- |
| Solyc03g104810.2.1 | (1178) | ------------------------------- |
| Glyma08g26230.1 | (1168) | ------------------------------- |
| Glyma18g49830.1 | (1170) | ------------------------------- |
| POPTR_0004s12000.1 | (1186) | ------------------------------- |
| POPTR_0017s12430.1 | (1188) | ------------------------------- |
| Solyc05q012770.2.1 | (1174) | ------------------------------- |
| AT1G13960.1 | (1158) | ------------------------------- |
| AT2G03340.1 | (1156) | ------------------------------- |
| POPTR_0008s09140.1 | (1190) | ------------------------------- |
| POPTR_0010s17040.1 | (1192) | ------------------------------- |
| Glyma20g03410.1 | (1166) | ------------------------------- |
| Glyma01g06550.1 | (1160) | ------------------------------- |
| Glyma02g12490.1 | (1162) | ------------------------------- |
| Bradi4g06690.1 | (1224) | ------------------------------- |
| Si021859m | (1216) | ------------------------------- |
| GRMZM2G143765_T01 | (1212) | ------------------------------- |
| GRMZM2G076657_T01 | (1208) | ------------------------------- |
| GRMZM2G076657_T02 | (1210) | ------------------------------- |
| LOC_Os03g33012.1 | (1200) | ------------------------------- |
| Bradi1g16120.1 | (1222) | ------------------------------- |
| GRMZM2G171428_T01 | (1206) | ------------------------------- |
| Si035317m | (1214) | ------------------------------- |
| Si012785m | (1330) | ------G--AGAAAPSVY-QLMRNGLPLGHQM |
| GRMZM5G816457_T01 | (1326) | ----GNVAGGAAPSVYQQMMCSGLRLRQQM |
| GRMZM5G816457_T02 | (1328) | ----GNVAGGAAPSVYQQMMCSGLRLRQQM |
| GRMZM2G031963_T01 | (1324) | ------------------------------- |
| Glyma04g12830.1 | (1334) | ER--GGLNLSNGSSVYQEIMSRMP-LGPHM |
| Glyma06g47880.1 | (1336) | EH--GGLNLSNGSSVYQEMMSRMP-LGPHM |
| Bradi4g33370.1 | (1302) | QS--EHAASSAYQOMMSRPP-FGSQM |
| LOC_Os08g38990.1 | (1306) | KVNLLPQSGNAGAAASQQLMGRLPKQHPQM |
| LOC_Os08g38990.3 | (1312) | KVNLLPQSGNAGAAASQQLMGRLPKQHPQM |
| Si013374m | (1316) | QSRLQVANGNA-MAAYQQFMGRLP-QGPQM |

FIG. 24O

| Sequence | | |
|---|---|---|
| LOC_Os03g21030.1 | (1503) | ----------------------------------MSEVSVMAEVEE-TAAAAPLDLPPGFRFHPTDEEIVSHYLTPK |
| GRMZM2G159500_T02 | (1499) | ----------------------------------MSEVSVINQAEVEDAGAGQLDLPPGFRFHPTDEEIISHYLAHK |
| AT3G04060.1 | (1471) | ----------------------------------MVEEGGVVVNQG--GDQEVVDLPPGFRFHPTDEEIITHYLKEK |
| AT5G18270.1 | (1473) | ----------------------------------MAVVEEGVVLN-HGGEELVDLPPGFRFHPTDEEIITCYLKEK |
| Glyma16g04720.1 | (1479) | ----------------------------------MEEPIVVNKGEE------PLDLPPGFRFHPTDEEIITYYLTEK |
| Glyma02g07760.1 | (1475) | ----------------------------MMEEPVVVNKGDDHDHEPLDLPPGFRFHPTDEEIITCYLTEK |
| Glyma16g26810.1 | (1477) | ----------------------------MMEEPVVVNKGDYDHDQPLDLPPGFRFHPTDEEIITCYLTEK |
| LOC_Os02g36880.1 | (1423) | MRLARQQQQVVVAATMEHDVHHHRQMMQQ--QQQQEMDLPPGFRFHPTDEELITHYLLRK |
| LOC_Os02g36880.3 | (1425) | MRLARQQQQVVVAATMEHDVHHHRQMMQQ--QQQQEMDLPPGFRFHPTDEELITHYLLRK |
| LOC_Os02g36880.2 | (1427) | MRLARQQQQVVVAATMEHDVHHHRQMMQQ--QQQQEMDLPPGFRFHPTDEELITHYLLRK |
| LOC_Os02g36880.4 | (1429) | MRLARQQQQVVVAATMEHDVHHHRQMMQQ--QQQQEMDLPPGFRFHPTDEELITHYLLRK |
| LOC_Os04g38720.1 | (1431) | ----------------------------MEQH------QGQAGMDLPPGFRFHPTDEELITHYLAKK |
| Si010553m | (1433) | ----------------------------MEQ-------ELHQPMELPPGFRFHPTDEELITHYLARK |
| Eucgr.I01958.1 | (1415) | ----------------------------MMSGTMIFEGDE-------QMELPPGFRFHPTDEELITHYLTPK |
| Solyc02g088180.2.1 | (1393) | ----------------------------MEIVCGFGGREE-------EMELPPGFRFHPTDEELITHYLAPK |
| AT3G29035.1 | (1373) | --------------------MDYKVSRSGEIVEGEV--EDSEKIDLPPGFRFHPTDEELITHYLRPK |
| AT3G39610.1 | (1369) | ----------------------MDYEASRIVEMV--EDEEHIDLPPGFRFHPTDEELITHYLKPK |
| Solyc03g115850.2.1 | (1395) | ----------------------MENFSAS--VKM--DDQQQMELPPGFRFHPTDEELITHYLSKK |
| Solyc06g069710.2.1 | (1397) | ----------------------MENYSGV--VKD--DD--QMELPPGFRFHPTDEELITHYLSNK |
| Glyma17g10970.1 | (1381) | ----------------------MENVPVV--CKE--DD--QMDLPPGFRFHPTDEELISHYLYKK |
| Glyma05g00930.1 | (1391) | ----------------------MENVPAV--CKE--DD--QMDLPPGFRFHPTDEELISHYLYKK |
| Glyma04g33270.1 | (1377) | --------------------------------MDLPPGFRFHPTDEELISHYLYRK |
| Glyma06g21020.1 | (1379) | ----------------------MENVSVLLCNKE--KD--QMDLPPGFRFHPTDEELISHYLYRK |
| Eucgr.B00529.1 | (1417) | ----------------------MENMARL--GKE--DD--QIELPPGFRFHPTDEELITHYLQKK |
| AT5G07680.1 | (1371) | ----------------------METFGVF--HKE--DDEQMDLPPGFRFHPTDEELITHYLHKK |
| AT5G61430.1 | (1375) | ----------------------METFCGFQKEEE-------QMDLPPGFRFHPTDEELITHYLSQK |
| Glyma13g05540.1 | (1383) | ----------------------MQAMENIHQREI--LEEQRFELPPGFRFHPTDEELITHYLSQK |
| Glyma19g02850.1 | (1385) | ----------------------------MEEQRFELPPGFRFHPTDEELITHYLSQK |
| Glyma09g37050.1 | (1387) | ----------------MGSMENVSKPRK---ENQKFELPAGFRFHPRDEELINHYLTKK |
| Glyma18g49620.1 | (1389) | ----------------MGSIENASKPRK---ENPKFELPAGFRFHPTDEELINQYLTKK |
| Consensus | (1467) | LPXGFRFHPxDEExxxxYLxxX |

```
LOC_Os03g21030.1       (1503) -PRSAKDQWAVCKVFNKELALAAKNGPMAVTEATADDA------GIERVGS-------
GRMZM2G159500_T02       1499  -PRSAKDEWAVCKVFNKE-LAARTEPIM---AAAGAG------ELERVGS-------
AT3G04060.1            (1471) -PKTARDEWVVCRVFHKN---APSTTI----------TTTK--QLSRIDS-------
AT5G18270.1            (1473) -PKSARDEWVVCRVFHKN--NPSTTT---QPMTRIPVE----DFTRMDS-------
Glyma16g04720.1        (1479) -PKAAKDEWVVCSRVFHKN--TDVKKS--------SIP----GLLRINS-------
Glyma02g07760.1        (1475) -PKASKDEWVVCKVFHKG--NTTTTDVVNKRALPIINP----CLLRMNS-------
Glyma16g26810.1        (1477) -PKAAKDEWVVCKVFHKS--STTTTD-VNKRVLPIINP----GLLRMNS-------
LOC_Os02g36880.1       (1423) --SKQDQEWVLCRVFKKS--LELAPA----------AAA---AVGRRGAGAGTDVGPSS
LOC_Os02g36880.3       (1425) --SKQDQEWVLCRVFKKS--LELAPA----------AAA---AVGRRGAGAGTDVGPSS
LOC_Os02g36880.2       (1427) --SKQDQEWVLCRVFKKS--LELAPA----------AAA---AVGRRGAGAGTDVGPSS
LOC_Os02g36880.4       (1429) ---SKDQEWVLCRVFKKS--LELAPA----------AAA---AVGRRGAGAGTDVGPSS
LOC_Os04g38720.1       (1431) KPASSKNEWVLCRVFKKSLVEVGAAGGKKAAVVTMEMA----RGGSTSS-------
Si010553m              (1433) -KPASKNEWVICRIFEKG--PDGKKA----------PAA---RRGAMEM-------
Eucgr.I01958.1         (1415) -SNSQKNDWVICRIFFKN--SGGKKI----------AIS---DQPETLPGGLERLSS
Solyc02g088180.2.1     (1393) -PKTAKNECVICRVISRVF-TDGTKE----------HMS---NLTRSDS-------
AT3G29035.1            (1373) -SKTAKNECVISRVF-HTR-ADGTKV----------PMS---MLD----------
AT5G39610.1            (1369) -PQTAKNEWVICRVFQKR--ADGTKV----------PMS---MLD----------
Solyc03g115850.2.1     (1395) -PKTVKNDWVICRVFQKT--TGGKKI----------HIS---GLVRANS------
Solyc06g069710.2.1     (1397) -PKTAKNEWVICRVFQKS--SGGKKI----------HIS---GLLKLNS------
Glyma17g10970.1        (1381) -PKTAKNEWVICRVFQKS--SAGKKT----------HIS---GIMRLDS------
Glyma05g00930.1        (1391) -PKTAKNEWVICRVFQKS--SAGKKT----------HIS---GIMRLDS------
Glyma04g33270.1        (1377) -PKTAKNEWVICRVFQKS--SGVKRT----------HIS---GMMMLDS------
Glyma06g21020.1        (1379) -PKTAKNEWVICRVFQKS--SGVKRT----------HIS---GMMMLDS------
Eucgr.B00529.1         (1417) -PRASKNEWVICRVFQKS--SGGKKI----------HIS---SLVAAGS------
AT5G07680.1            (1371) -PKTAKNEWVICRVFHKT--AGGKKI----------PIS---TLIRIGS------
AT5G61430.1            (1375) -PKTAKNEWVICRVFQKS--AGGKKI----------PIS---SLIRIGS------
Glyma13g05540.1        (1383) -PKKAMNDWAICRIFQKS--NGGKKM----------PIS---GLVRFSN------
Glyma19g02850.1        (1385) -PKKAMNDWAICRIFQKS--NCGKKM----------PIS---RLLRFST------
Glyma09g37050.1        (1387) -PNPGKSEWVICRVFFKS--PCGKKM----------HVL---KCGRLNN------
Glyma18g49620.1        (1389) -PKPGKSEWVICRVFFKS--RCGKKM----------HVP---KCGRFNN------
Consensus              (1468)                XxxXXXXF
```

FIG. 29D

| Sequence | | |
|---|---|---|
| LOC_Os03g21030.1 | (1503) | --FSFLSDFIDPAELPPLMD--------------------------------------------PSFVADI------DGVDDA |
| GRMZM2G159500_T02 | ( 1499) | --LGFLSELLDSAELPALIG------------------------------------------------ADV-------DEVIDF |
| AT3G04060.1 | (1471) | --LDNIDHLLDFSSLPPLIDPGFLGQPGPSFSGARQQHDLKPVLHHPTTAPVDNTYLPTQ |
| AT5G18270.1 | (1473) | --LENIDHLLDFSSLPPLID----------PSF----------------------MSQTEQPNFKPINPPTYDISSPIQ |
| Glyma16g04720.1 | (1479) | ---IGDD---LLDYSSLPSLMD-------PPYGNNTNTTNNNNNANPLSSTKLSQSEGYYLPSF |
| Glyma02g07760.1 | (1475) | ---SIGE-DLFDFSSLPPLVDPLFDQTSNKHIDNDFKGTNNTPSSSSAKP-PSSGYYLPNF |
| Glyma16g26810.1 | (1477) | --SNGEDLIFDFSSLPPLVDPLFDQTSNKHIDNDFKGTNNTPSSSSAKLPSSSGYYLPNF |
| LOC_Os02g36880.1 | (1423) | MPMADDVVGLAPCALPPLMD-----VSGGGGAGTTSLSATAGAAAPPP-----AHVTCF |
| LOC_Os02g36880.3 | (1425) | MPMADDVVGLAPCALPPLMD-----VSGGGGAGTTSLSATAGAAAPPP-----AHVTCF |
| LOC_Os02g36880.2 | (1427) | MPMADDVVGLAPCALPPLMD-----VSGGGGAGTTSLSATAGAAAPPP-----AHVTCF |
| LOC_Os02g36880.4 | (1429) | MPMADDVVGLAPCALPPLMD-----VSGGGGAGTTSLSATAGAAAPPP-----AHVTCF |
| LOC_Os04g38720.1 | (1431) | --SVADEIAMSSVVLPPLMD-----MSG----------AGAGAVDPATT------AHVTCF |
| Si010553m | (1433) | --AAKMDDMAAISHLPPLMD-----VSG----------AAANPAA--------AHVTCF |
| Eucgr.I01958.1 | (1415) | --FDNE-PKASLLPLPPLVE-----SSP-----------------------------FTTTSF |
| Solyc02g088180.2.1 | (1393) | ---ITDN---SRSSNLPPLMD-----LSP------YNKITTARSSGETCN-----SHVTCF |
| AT3G29035.1 | (1373) | -----------VGLPPLMD-----SSP------YLKSRGQDSLAGTTLGGLLSHVTYF |
| AT5G39610.1 | (1369) | --PHINRMEPAGLPSLMD-----CSQ---------RDSFTGSS---------SHVTCF |
| Solyc03g115850.2.1 | (1395) | ---DENE---MVNTVLPPLTD-----SSP---------------------------SHVHCF |
| Solyc06g069710.2.1 | (1397) | ---NENE---MGNSFLPPLTD-----SAT-----------ATASKS---------SHVHCF |
| Glyma17g10970.1 | (1381) | ---FADE---LGSSALPPLSD-----SSP-------SIGNTKPLNDT------AYVPCF |
| Glyma05g00930.1 | (1391) | ---FANE---LGSSALPPLSD-----SSP-------SIGNTKPLNDS------AYVPCF |
| Glyma04g33270.1 | (1377) | ---YGNE---LGYSSSALPPLTD-----SSP-----SIDNTKVLSVTDT----AYVPCF |
| Glyma06g21020.1 | (1379) | ---YGNE---MVYSSSALPPLTD-----SSP-----SIGNNTKALSVTDS---AYVPCF |
| Glyma06g21020.1 | (1417) | ---LENE---MSSGLPPLTD-----SSP-------HDSKTESNPGS-------AYVPCF |
| Eucgr.B00529.1 | (1371) | ---YGTG---SSLPPLTD-----SSP--------YNDKTKTEP---------VYVPCF |
| AT5G07680.1 | (1375) | ---LGTD---FNPSILPSLTD-----SSP--------YNDKTKTEP---------VYVPCF |
| AT5G61430.1 | (1383) | ---FAKD---MPSLMD-----SSP---------YNDSESKPVLGES-------SQPTCF |
| Glyma13g05540.1 | (1385) | ---FAKD---IPSLMD-----SSP---------NNNNNSESKPVLGES-----SHATCF |
| Glyma19g02850.1 | (1387) | --SSGEEPSSCASILPPLID-----SSP--------YNSETRTTAGEL-----SQLTCF |
| Glyma09g37050.1 | (1389) | --PFGEEPSSGASILPPLMD-----SSP--------YNSETRTTAGEL-----SQVTCF |
| Consensus | (1469) | XPxLxX |

FIG. 29E

```
LOC_Os03g21030.1      1503)  K---VSASTSGQAAI----------------------------AAGFHVASQV-MSYQQVKMEEPL
GRMZM2G159500_T02     1499)  N----GP----------------------------------------ASTSGAP-GTSHSHLPVKME
AT3G04060.1           (1471) A-------------------------------------------------------LNFPYHSVHNSG
AT5G18270.1           (1473) P----------------------------------------------------------HHFNSYQ
Glyma16g04720.1       (1479) SINNNHHQLLIKPEDHHNHRIYEFPTINFTSNQTNLSSNNVNPMGNNNTLSSQPLNMFSA
Glyma02g07760.1       (1475) I---NN---NNNQHMLMMKPEEHKMYEIPTNNYASTSQVNFTTTNNPIMGISIGNNNTLL
Glyma16g26810.1       (1477) N-------NNNNQQMLMMKPEEHKIYEIPINNYASTSQVDFTTTNNP-MGISTSNNNILL
LOC_Os02g36880.1      (1423) S----NA--LEGQFL--------------------------------DTPYLLP-AADPADHLAMSS
LOC_Os02g36880.3      (1425) S----NA--LEGQFL--------------------------------DTPYLLP-AADPADHLAMSS
LOC_Os02g36880.2      (1427) S----NA--LEGQFL--------------------------------DTPYLLP-AADPADHLAMSS
LOC_Os02g36880.4      (1429) S----NA--LEGQFL--------------------------------DTPYLLP-AADPADHLAMSS
LOC_Os04g38720.1      (1431) S----NA--LEGQFFN-------------------------------PTAVHGHGGGDSSPFMASFT
Si010553m             (1433) S----NA--LEGQSFL------------NQTAAPQV-AAAAATDHLGLAS--SSPFLSSFAQYG
Eucgr.I01958.1        (1415) S----DR--PEDRNAQ----------K--------------------TSLFSSP-SSSELDQSLGPA
Solyc02g088180.2.1    (1393) S----DS--MEDQKP-----------QTYDHH---------------HLLSSSP-VSVDFPQNVPND
AT3G29035.1           (1373) S----DQ--TTDDKSL-------------------------------VADFKTTMFGSG
AT5G39610.1           (1369) S----DQ-ETEDKRL--------------------------------VHESKDGF----
Solyc03g115850.2.1    (1395) S----NY--VTTQKNQ---------ENNMINSFNNSPN---------FPLLSNS-IDIFQRNSL-PT
Solyc06g069710.2.1    (1397) S----NF--LTAQNN----------C---------------------FPLLSNP-MDSYPTTSLVPN
Glyma17g10970.1       (1381) S----NP--IDVQRN----------QEGVFDSF---TNSIYAVSSNP-MGILPRMPP-SG
Glyma05g00930.1       (1391) S----NP--IDVQRN----------QEGVFDSF---TNSM--YGVSSNP-MDILPRMPP-SG
Glyma04g33270.1       (1377) S----NP--IDAPRGI---------FDSLNNI---NITTTTTNNNN
Glyma06g21020.1       (1379) S----NP--IDVPRGI---------NNINISI-NSNTLYGVSSNH
Eucgr.B00529.1        (1417) S----SP--TEFERN----------FDSL------------------KENTNNYF--NNPM--FPISSNP-TNTTPKISL-LS
AT5G07680.1           (1371) S----NQ--AETRGTI---------------------------LNCFSNPSLSSIQPDFLQMI
AT5G61430.1           (1375) S----NQ--TDQNQGT---------------------------TLNCFSSPVLNSIQADIFHRI
Glyma13g05540.1       (1383) S----DPNQSDSYETL---------MLASSYSSNP-SDISPASWT-FS
Glyma19g02850.1       (1385) S----DPNQSEDKKTE---------NENIAESY-EIIMLASSYSSNP-SDVSPDSWT-FS
Glyma09g37050.1       (1387) S----DPNQTEDQNNT---------HDDIVDSM-ETPILNFSPSSRP-DDASTLAKATLS
Glyma18g49620.1       (1389) S----DPNQTEDQNNT---------HDDIVDSM-ETPILNFSPFSRP-DDASTLAKATLS
```

FIG. 29F

```
LOC_Os03g21030.1    (1503)  PLPYLHQQPPRMLHSGQYFSLPAVHPGDLTPSA-IRRYCKA-----------EQVSGQTSA-
GRMZM2G159500_T02   (1499)  EHALLHMQYQPPPPTSYYSSQYFSL----PAMN-SGDVLPP-------AIRRYCKAEQQVV
AT3G04060.1         (1471)  S-----------------DFGYGAGSGNNN----KGMI----------------KLEHSL-
AT5G18270.1         (1473)  SIFNHQVF--------GSASGSTYNNN-----NEMI------------------KMEQSL-
Glyma16g04720.1     (1479)  DYYVHQNRIKSSIMPSVAGSGFVSDNNNHDEAI-LRAFAAK-----NNEHIQCKMEQFS--
Glyma02g07760.1     (1475)  SQPQIRTQNSTSVPFNMFQDYNYMN---QGKQ-CKME----------QFSNTKNQPV---
Glyma16g26810.1     (1477)  SQPQIRTQNSTSVPFNMFQDCYNHTHQGKQCKM-EQFSIDS-----------TKKQPV---
LOC_Os02g36880.1    (1423)  ASPFLEALQMQYVQDAAAAGGAGMVH----ELLM-GGGWY--------------CNKGERER-
LOC_Os02g36880.3    (1425)  ASPFLEALQMQYVQDAAAAGGAGMVH----ELLM-GGGWY--------------CNKGERER-
LOC_Os02g36880.2    (1427)  ASPFLEALQMQYVQDAAAAGGAGMVH----ELLM-GGGWY--------------CNKGERER-
LOC_Os02g36880.4    (1429)  ASPFLEALQMQYVQDAAAAGGAGMVH----ELLM-GGGWY--------------CNKGERER-
LOC_Os04g38720.1    (1431)  QYGQLHHGVSLVQLLESCNGYGGLVD---MAAS-GSQLQPA-------------ACGGERER-
Si010553m           (1433)  SLHHGVSLVQLLESSGYAGGGLPD---MPKQ-QQQPAPP-------------CKGGERER-
Eucgr.I01958.1      (1415)  HSFGWSDTV----------------FMH--EQAI-LRMLLEN-------------SASNAKAEY-
Solyc02g088180.2.1  (1393)  SMTYMGNFQ---------YGDSGLMQ----DNSI-MRLLIDN---------------------
AT3G29035.1         (1373)  STNFLPNI---------GSLLDFDPLFLQN----NSSV-LKMLLDN-----------EETQ--
AT5G39610.1         (1369)  ---------------GSLFYSDPLFLQD----NYSL-MKLLLDG-----------------
Solyc03g115850.2.1  (1395)  SFTWNQNVP---LQHNFPQPGSFPIQD----PAT--LRNLLENYG-----HQSFKKETDM-
Solyc06g069710.2.1  (1397)  TFSCNQIAP--FTTT-NNPASFGVQD----PSIL-LRTSLDSYG-----LNFKKE-DI--
Glyma17g10970.1     (1381)  SFYSTQGVQ--AAPNLAFPGSVYTLQ----DHTI-LRTLCEN-------NGYKPERDM--
Glyma05g00930.1     (1391)  SFYSTQGVQ--AAPNFAFPGSVYTLQ----DHTI-LRALCEN-------NGYKPERDM--
Glyma04g33270.1     (1377)  TLYGVSSNHSFYNTQLHIPPTLPIPS----SSNHYIRAFLENQGNGSNMRNGYETEREM-
Glyma06g21020.1     (1379)  SFYNTQGVQLQAPPTLPLPSSS-------NHY-LRAFLENQGNGSNMSNNGFEPEREM-
Eucgr.B00529.1      (1417)  PVYPHQAIP--VPANWQHPGGSVFMP----EHSV-LRALLEGTGLNA--RQSARAEREA-
AT5G07680.1         (1371)  PLYQPQSL-----NISESSNPVLTQ----EQSV-LQAMMEN------NRRQNFKT-
AT5G61430.1         (1375)  PLYQTQSLQ-----VSMNLQSPVLTQ----EHSV-LHAMIEN------NRRQSLKT-
Glyma13g05540.1     (1383)  KSAPTVSHQSLQVGNSHSSDYFMLHQ----EQSM-LGMLIEN------HGASAGQRTQ-
Glyma19g02850.1     (1385)  KSAPTVSHQSLQVGNSHCSDYFMLHQ----EQSM-LGMLIEN------HGSSTGQRTQ-
Glyma09g37050.1     (1387)  SASNQSAQIAHQIGNSQFPDYYHVPQ----EQSM-LRMLMEK------QGPIANQIQK-
Glyma18g49620.1     (1389)  SASNQSAQIAHQIGESQFPDYCYAPQ----EPSM-LRMLMEN------HEPCAKQTQK-
```

FIG. 29G

```
LOC_Os03g21030.1      (1503) ----------LS-ASRDTG-LSTDPNAAGCAEI---SSAPTSQPFPEFDDG---------I
GRMZM2G159500_T02     (1499) SGQTAASEVS-PSRETG-LSADPNA-EISS-AV-TPSSSHQFLPEFDDP---------V
AT3G04060.1           (1471) ----------VS-VSQETG-LSSDVNTTATPEISSYPMMNPAMMDGSKSA-------CDG
AT5G18270.1           (1473) ----------VS-VSQETC-LSSDVNANMTTTEVSSGPVMKQEM-GMMGM-VNGSKSYEDL
Glyma16g04720.1       (1479) ----------SN-HSQDTG-LSNDRNTTDTSSVVSMGRNNNNRALYEDLEGPSSV---APL
Glyma02g07760.1       (1475) ----------VS-ASQDTC-LSNDTSS--VVSKQDN-NIGRNKALYEDNFEAPSSVA---TTL
Glyma16g26810.1       (1477) ----------VS-ASQDTC-LSNDTSS--VVSKQDNNMGRNKALYEDNFEGPSSVA---TTL
LOC_Os02g36880.1      (1423) ----------LSGASQDTGLTSSEVNPGEISS---------SSRQQRM-DHHDA-------
LOC_Os02g36880.3      (1425) ----------LSGASQDTGLTSSEVNPGEISS---------SSRQQRM-DHHDA-------
LOC_Os02g36880.2      (1427) ----------LSGASQDTGLTSSEVNPGEISS---------SSRQQRM-DHHDA-------
LOC_Os02g36880.4      (1429) ----------LSGASQDTGLTSSEVNPGEISS---------SSRQQRM-DHHDA-------
LOC_Os04g38720.1      (1431) ----------LS-ASQDTG-LTSDVNP-EISS---------SSGQKF-DHEAA--------
Si010553m             (1433) ----------LS-ASQDTG-LTSDVHP-EISS---------SSGQRF-DHEQL--------
Eucgr.I01958.1        (1415) ----------AD-FSQARR-------------------QDREA-TMPT---SFQ
Solyc02g088180.2.1    (1393) ----------N-YGSESK---------------QSLRGY-EDHDI-NISS---TGP
AT3G29035.1           (1373) ----------FKKNLHNSGSSESELTA----------SSWQGH-NSYGS---TGP
AT5G39610.1           (1369) ----------------QETQ----------------FSGKPF-DGRDS--------SGT
Solyc03g115850.2.1    (1395) ----------IS-VSQETG-ISTDRNT-EITS--------------------AQ
Solyc06g069710.2.1    (1397) ----------FN-VPQETGVISTDMNT-DITSVVS-NLEMKRRFL-EDQVP-SAGM---VGL
Glyma17g10970.1       (1381) ----------IS-VSQETG-LTTDINA-ETSS---------NFDMGRRPF-ENHNH-ASVS---VAP
Glyma05g00930.1       (1391) ----------IS-VSQETG-LTTDINA-ETSS---------NFDVGWRPF-ENHNH-ASVS---VAP
Glyma04g33270.1       (1377) ----------VS-VSQETT-ISTDVNA-EISS---------LGKRQFENQQNPTASSA---VVP
Glyma06g21020.1       (1379) ----------VS-VSQKTS-LSTDVKA-EISS---------LGKRHF-ENQNN-PIASAAAVAP
Eucgr.B00529.1        (1417) ----------IS-ISQETA-LTNDLNT-EISSVMQ-DFEMGRRQFEDQQQV-PSTL---AGP
AT5G07680.1           (1371) ----------LS-ISQETGVSNTDNSS----------VFEFGRKRF-DHQEV-PSPS---SGP
AT5G61430.1           (1375) ----------MS-VSQETG-VSTDMNT-DISS---------DFEFGKRRF-DSQED-PSSS---TGP
Glyma13g05540.1       (1383) ----------KAQDSKGSDADMSS-VMYN---------NYEMFQRSF-GNQEY-SSPS---VGH
Glyma19g02850.1       (1385) ----------KA-QDNNKD-FDADMSS-VMYN---------NNEMFQRSF-GNQEY-SSPS---VGH
Glyma09g37050.1       (1387) ----------PE-FSEGRD-FDADISS-MIYN---------N-DMMHRMF-GNQEH-SSAS---AGP
Glyma18g49620.1       (1389) ----------EE-FPEGRD-FDGDISS-MIYS---------S-DMINRMF-GNQEHSSSSAS---AGP
```

FIG. 29H

| | | |
|---|---|---|
| LOC_Os03g21030.1 | (1503) | LGLDDF-W--N--- |
| GRMZM2G159500_T02 | (1499) | LNLADL-W--KY-- |
| AT3G04060.1 | (1471) | LDDLIF-WEDLYTS |
| AT5G18270.1 | (1473) | CDLRGDLW--DF-- |
| Glyma16g04720.1 | (1479) | SDLECLQWDDDY- |
| Glyma02g07760.1 | (1475) | SDLECL-W-DDY-- |
| Glyma16g26810.1 | (1477) | SDLECL-W-DDY-- |
| LOC_Os02g36880.1 | (1423) | ----SL-W--AY-- |
| LOC_Os02g36880.3 | (1425) | ----SL-W--AY-- |
| LOC_Os02g36880.2 | (1427) | ----SL-W--AY-- |
| LOC_Os02g36880.4 | (1429) | ----SL-W--AY-- |
| LOC_Os04g38720.1 | (1431) | ----L-W--GY-- |
| Si010553m | (1433) | ------W--GY-- |
| Eucgr.I01958.1 | (1415) | CDVDCL-W--RN-- |
| Solyc02g088180.2.1 | (1393) | VDIDCL-W--NY-- |
| AT3G29035.1 | (1373) | VNLDCV-W--KF-- |
| AT5G39610.1 | (1369) | EELDCV-W--NF-- |
| Solyc03g115850.2.1 | (1395) | QDLDCF-W--TY-- |
| Solyc06g069710.2.1 | (1397) | QGLDCL-W--SC-- |
| Glyma17g10970.1 | (1381) | LDLDGL-W--NY-- |
| Glyma05g00930.1 | (1391) | LDLDGL-W--NY-- |
| Glyma04g33270.1 | (1377) | MDVATL-W--NY-- |
| Glyma06g21020.1 | (1379) | MDLATL-W--NY-- |
| Eucgr.B00529.1 | (1417) | MDVDLL-W--NYSS |
| AT5G07680.1 | (1371) | VDLEPF-W--NY-- |
| AT5G61430.1 | (1375) | VDLEPF-W--NY-- |
| Glyma13g05540.1 | (1383) | VYSSGL-W--GF-- |
| Glyma19g02850.1 | (1385) | VYSSGL-W--GF-- |
| Glyma09g37050.1 | (1387) | VDTDFL-W--NY-- |
| Glyma18g49620.1 | (1389) | VDTDFL-W--NY-- |
| | | W |

FIG. 29I

| Solyc12g096350.1.1 | (1517) | -MAV------------LSK--M----------NESFAVEEAASAGLKSMENLIRLVSHE----------P |
| LOC_Os08g13840.1 | (1525) | -MAVDL----MGFSPRGGCRPSVETEQLAFQEAAAAGLRSLELLVSSLSAG----------G |
| LOC_Os08g13840.2 | (1527) | -MAVDL----MGFSPRGGCRPSVETEQLAFQEAAAAGLRSLELLVSSLSAG----------G |
| GRMZM2G071907_T01 | (1529) | -MAVDLM---GCYAPRRA---------NDQLAIQEAAAAGLRNLELLVTSLSTQ----------A |
| GRMZM2G091331_T01 | (1531) | -MAVDLM---GCYAPRRA---------NDQLAIQEAAAAGLRSLELLVSSLSTQ----------A |
| AT2G24570.1 | (1507) | -MTVDI----MRLPK--M---------EDQTAIQEFAASQGLKSMEHLIRVLSNR----------P |
| AT4G31550.1 | (1509) | -MAVDL----MRFPK--I---------DDQTAIQEAASQGLQSMEHLIRVLSNR----------P |
| Eucgr.C04011.1 | (1521) | -MAIELH---LGFSK--M---------EDHTAIQEAASQGLKTMEHLIGVLSRQ----------N |
| Eucgr.C04011.2 | (1523) | -MAIELH---LGFSK--M---------EDHTAIQEAASQGLKTMEHLIGVLSRQ----------N |
| clementine0.9_014855m | (1519) | -MAVEL----MGFPKRMM---------EDQTAIQEAATQGIKSMEHLIRLMSHH----------Q |
| Glyma14g17730.1 | (1511) | -MALEL----MGFPK--L---------DEQKAIQEAASEGLKGMEHLIRTLSHQ----------P |
| Glyma17g29190.1 | (1513) | -MAVEL----MGFPK--L---------DEQKAIQEAASEGLKGMKHLIRTLSNQ----------P |
| Glyma06g08120.1 | (1515) | -MTVEL----MGFPK--M---------EEQKAIQEAASEGLKAMEHLLRLLSYQ----------P |
| Solyc08g006320.2.1 | (1575) | -MAVDL----LNYSN--L---------NEQLALQEAATAGLKSMDNLIRFVSFQ----------Q |
| Bradi3g18580.1 | (1581) | -MAVDLMGRGGGYSAPRA---------EQEQQRAFQDAATAGLRSLELLVSSLSPR----------A |
| LOC_Os04g51560.1 | (1577) | -MAVDLM---GCYAPRRA---------DDQLAIQEAATAGLRSLEMLVSSLSSS----------S |
| Bradi5g04817.1 | (1563) | MMTMDLM---GGYGR--A---------DEQAAIQEAAAAGLRGMEHLIRLSQTGTGAES------S |
| LOC_Os04g21950.1 | (1565) | MITMDLM---GGYGR--V---------DEQVAIQEAAAAGLRGMEHLIQLSQT------------G |
| GRMZM2G102583_T02 | (1567) | MTTLDLM---GGYGR--V---------DEQVAIQEAATAGLRGMERLILQLSQAGTGERSLSP   |
| POPTR_0018s03450.1 | (1579) | -MAVEL----MSFNTK-M---------DDQSAIQEAASQGIKSMEHLIRIMSHQ----------N |
| Glyma09g06980.1 | (1569) | MMALDMI---DVVPRTRM---------EEENIAIQEAASAGLKSMEHLIRLLSPS----------S |
| Glyma15g18250.1 | (1571) | MMALDMI---DVVPRTRM---------EEENIAIQEAASAGLKSMEHLIRLLSPT----------S |
| Glyma13g00380.1 | (1573) | -MTVDL----VGAAKMGM---------EENIAIQEAASAGLKSMEHLIRVLSSQ----------I |
| Glyma17g06450.1 | (1589) | -MAVDL--------ANIRM--------EENMAIQEAASAGLKSMEHLIRVLSSQ----------I |
| GSVIVT01029265001 | (1587) | -MAVDF----LGFSK--M---------DEQMAIQEAASAGLKSMEHLILLNHH----------H |
| POPTR_0006s07170.1 | (1583) | -MAVDL----VRYSK--M---------EDQMAIQEAASAGLESMEHLIFAFSNQ----------T |
| POPTR_0018s13600.1 | (1585) | -MAVDL----VGYSK--M---------EDQMAIQEAASAGIKSMEHLIFALSNQ----------T |

Fig. 33A

| Sequence | | | |
|---|---|---|---|
| Solyc12g096350.1.1 | (1517) | VQA----------------DCREMADFT | VSKFKKKVISILD | RTGHARFRRGPVQAQAPA |
| LOC_Os08g13840.1 | (1525) | EHHH-------RRRPQEKQSSPPLGEIADQA | VSRFRKVISILD | RTGHARFRRGPVVGAAA- |
| LOC_Os08g13840.2 | (1527) | EHHH-------RRRPQEKQSSPPLGEIADQA | VSRFRKVISILD | RTGHARFRRGPVVGAAA- |
| GRMZM2G071907_T01 | (1529) | AAPH---------RAADQPFGEIAGQA | VSKFRKVISILD | RTGHARFRRGPVVGAAA- |
| GRMZM2G091331_T01 | (1531) | AAPH--RAAAHQLQKPPSQPPIGEIADQA | VSRFRKVISILD | RTGHARFRRGPVVE---- |
| AT2G24570.1 | (1507) | EERN---------------VDCSEITDFT | VSKFKKVISLLN | RSGHARFRRGPVHSPPSS |
| AT4G31550.1 | (1509) | EQQH---------------NVDCSEITDFT | VSKFRKVISLLN | RTGHARFRRGPVHSTSSA |
| Eucgr.C04011.1 | (1521) | LHHP-------------GAVDCTDLTDRT | VSKFRKVISLLD | RTGHARFRRAPLPSSSSS |
| Eucgr.C04011.2 | (1523) | LHHP-------------GAVDCTDLTDRT | VSKFRKVISLLD | RTGHARFRRAPLPSSSSS |
| clementine0.9_014855m | (1519) | SSNH-------------VDCSDLTDLT | VSKFKKVISLLN | RTGHARFRRGPVHSSPSS |
| Glyma14g17730.1 | (1511) | FHLN----------------TELTDVT | VSKFKKLISLLN | RTGHARFRRAPVQYSSPP |
| Glyma17g29190.1 | (1513) | SHLN----------------TELTDVT | VSKFKKLISLLN | RTGHARFRRAPVQYSSPH |
| Glyma06g08120.1 | (1515) | SHLH----------------AHHTDAT | VSNFKKLISLLR | RTGHARFRRAPL----- |
| Solyc08g006320.2.1 | (1575) | QQNQ-----------TVQPDCREITDYT | VSNFRKVITILN | RTGHARFRRSPVQTDDS |
| Bradi3g18580.1 | (1581) | ADRA-----------TAAPLGEIADQT | VSRFRRVINMLD | RTGHARFRRGPVVSSPS- |
| LOC_Os04g51560.1 | (1577) | QAAG-----------AHKASPQQQPFGEIADQA | VSKFRKVISILD | RTGHARFRRGPVESSAPA |
| Bradi5g04817.1 | (1563) | PAVAAPEQAKGKQQQQEQQQEQVDCREITDMT | VSKFKKVISMLN | RTGHARFRRGPV----- |
| LOC_Os04g21950.1 | (1565) | TSER-----SPAPAQEQQQQVDCREITDMT | VSKFKKVISMLN | RTGHARFRRGPV----- |
| GRMZM2G102583_T02 | (1567) | PAVQAQRQQQKQLEQIQQQVDCRELTDMT | VSKFKKVISILN | RTGHARFRRGPV----- |
| POPTR_0018s03450.1 | (1579) | NHHV--------------ADCTDLTDVT | VSKFKQVISILN | RTGHARFRRGPIQPNQPA |
| Glyma09g06980.1 | (1569) | SLHN---------QINHFDCREITDFT | VSKFKQVISMLN | RTGHARFRRSPP----- |
| Glyma15g18250.1 | (1571) | SNSN--SSSSPLLNTNPNNLHCSQITDFT | VSNFKQVINLLN | RTGHARFRRSPP----- |
| Glyma13g00380.1 | (1573) | PSSASSSSNAHHHRLNLNHLDCTEITDFT | VSKFKQVINLLN | RTGHARFRSAPS----- |
| Glyma17g06450.1 | (1589) | PSASSSSSNAHHHRLNLNHLDCAEITDFT | VSKFKQVINLLN | RTGHARFRRAP----- |
| GSVIVT01029265001 | (1587) | PQSQ---------QINHFDCREITDFT | VSKFKQVISILN | RTGHARFRRGPV----- |
| POPTR_0006s07170.1 | (1583) | RQSH---------QLDCGEITNFT | VAKFKQVISMLN | RTGHARFRRGPT----- |
| POPTR_0018s13600.1 | (1585) | QQSH---------QLDCREITSFT | VAKFKQVISILN | RTGHARFRRGPT----- |
| Consensus | (1558, 1559) | | VXxFXxxIXXL | RXGHARFRRXP |

Fig. 33B

```
Solyc12g096350.1.1    (1517)  PVQVRAPVRGPVYPDSFTSLSLAPSLSFATAKERLAPSLSFASAKERPVVQV----TAL
LOC_Os08g13840.1      (1525)  ------------------------------AEAAAAAASASPSSSSPVSPPLPPVTTQPAAAVKSL
LOC_Os08g13840.2      (1527)  ------------------------------AEAAAAAASASPSSSSPVSPPLPPVTTQPAAAVKSL
GRMZM2G071907_T01     (1529)  ------------------------------EPPPTPPPPVVPGPAPLAAVSVAQPP----QSL
GRMZM2G091331_T01     (1531)  ------------------------------APPPVPPPAVSAPALPVAHVVAPVGAAQP----QSL
AT2G24570.1           (1507)  S-----------------------------VPPPVKVTTPAPTQISAPAPVSFVQANQ----QSV
AT4G31550.1           (1509)  ------------------------------ASQKLQSQIVKNTQPEAPIVRTTNHPQIVPPP----SSV
Eucgr.C04011.1        (1521)  -----------SSKSAPVASPVPPAVQSRSQPLAPTPIQAPTSSQPSPASFLHAQPK----QSL
Eucgr.C04011.2        (1523)  -----------SSKSAPVASPVPPAVQSRSQPLAPTPIQAPTSSQPSPASFLHAQPK----QSL
clementine0.9_014855m (1519)  -----------SSASAPAAAAASGNSPHTQTLTLTPPAPTMAVAPSTASYVQSQP------HSL
Glyma14g17730.1       (1511)  -----------APVHNANTSTSSIQLPPPPQNPNIPAPVQFPSPAPVAVHH-----APV
Glyma17g29190.1       (1513)  -----------APVHNTNASTSSIQLPPPPQNPNIPALAQFPTPAPVAVHH-----TPV
Glyma.06g08120.1      (1515)  --------------------------PSPPPANPVTLHQPPSTFVPSHS------QSL
Solyc08g006320.2.1    (1575)  -----------STALTLSPLTNPAEETVPAVKVPVEKYQS-----KAL
Bradi3g18580.1        (1581)  -----------PAPTPSKPPPVSSSSPAPAPAPAVAPAPP-----KTL
LOC_Os04g51560.1      (1577)  -----------APVAAAPPPPPPAPVAAALAPTSSQP--------QTL
Bradi5g04817.1        (1563)  -----------------------VAQSQGPEHQQQAPVVVRS-------SSV
LOC_Os04g21950.1      (1565)  -----------VAQSSGPAASEPAPVRSSPSAVS-----------RPM
GRMZM2G102583_T02     (1567)  --------------------AARSQSQSQGPASPEPAQSAPAPAA----RPL
POPTR_0018s03450.1    (1579)  KSSFSLSPPSTSTQSPQSQSQSPSFSRFQNLTLTPQQITTPVTAPAAP------TSL
Glyma09g06980.1       (1569)  ----------QAQAQAQAQAQTQTQTQTSLQPQPETQ---------QGF
Glyma15g18250.1       (1571)  ----------QAQAQAQTQTQTQTSLQPQPETQ-------------QGF
Glyma13g00380.1       (1573)  ----------HPSPSTSLPSQPQPQPQP------------------YAL
Glyma17g06450.1       (1589)  ----------SHPSPSISPSQPQPQPQP------------------QTL
GSVIVT01029265001     (1587)  -------TSSPSHPFHSNLI-------------------------
POPTR_0006s07170.1    (1583)  -----SSPSSYPVPVRPVPQEP------------------------QKL
POPTR_0018s13600.1    (1585)  -----SSNPVSVRPVVQEP-------------------------QKL
```

Fig. 33C

| Sequence ID | | | |
|---|---|---|---|
| Solyc12g096350.1.1 | (1517) | TLDFSKL------NVNRPIGNSSAFTAFT------VKSKEVLMADPTPTNSSFMSTIT--- | |
| LOC_Os08g13840.1 | (1525) | TLDFTNP------------------------AKV---------AAASVTSTSFFSSVTA--- | |
| LOC_Os08g13840.2 | (1527) | TLDFTNP------------------------AKV---------AAASVTSTSFFSSVTA--- | |
| GRMZM2G071907_T01 | (1529) | TLDFTKP------------------------NLAVS-------AATSVTSTSFFSSVTA--- | |
| GRMZM2G091331_T01 | (1531) | TLDFTKP------------------------NLAVS-------GGATSVTSTSFFSSVTA--- | |
| AT2G24570.1 | (1507) | TLDFTRP--SVFGAK---TKSSEVEEFA-----KE---------SFSVSSNS-SFMSSAIT--- | |
| AT4G31550.1 | (1509) | TLDFSKP--SIFGTK---AKSAELEFS------KE---------NFSVSLNS-SFMSSAIT--- | |
| Eucgr.C04011.1 | (1521) | TLDFTRP--SILGPN---SKGVSEIEFA-----KD---------SFSVSSNS-SFMSSAIT--- | |
| Eucgr.C04011.2 | (1523) | TLDFTRP--SILGPN---SKGVSEIEFA-----KD---------SFSVSSNS-SFMSSAIT--- | |
| clementine0.9_014855m | (1519) | TLDFTKP--SLFSGN---VKST-ELEFS-----KD---------SFCVSSNS-SFMSSAIT--- | |
| Glyma14g17730.1 | (1511) | TLDFTKPHNALLSSN---AKSV-ELEFS-----KE---------TFSVSSNS-SFMSSAIT--- | |
| Glyma17g29190.1 | (1513) | TLDFTKPHNALLSSN---AKSV-ELEFS-----KE---------TFSVSSNS-SFMSSAIT--- | |
| Glyma06g08120.1 | (1515) | TLDFTKP--SIFASN---AKSM-DLQFS-----KE---------TFSVSSNS-SFMSSAIT--- | |
| Solyc08g006320.2.1 | (1575) | TLDFTKR--------KVGKSIGCEAVP---------------VASSTTSSSFMSTIT--- | |
| Bradi3g18580.1 | (1581) | TLDFTKP----------------TK---------------AAASVTSTSFFSSVTAAG | |
| LOC_Os04g51560.1 | (1577) | TLDFTKP----------------NLTMS------------AATSVTSTSFFSSVTA--- | |
| Bradi5g04817.1 | (1563) | TLDFTKA----------GYGNKDAGLS-------------VSAATASSSFLSSVT--- | |
| LOC_Os04g21950.1 | (1565) | TLDFTKA----------ASGYGKDAGFS------------VSGISAASSSFLSSVT--- | |
| GRMZM2G102583_T02 | (1567) | TLDFTKS------------------VSGYS----RDS---GFSVSGASSSFLSSVTT--- | |
| POPTR_0018s03450.1 | (1579) | TLDFTKP--NIFSS------KSA-EIEFS-----KD---------SFSVSSNSASFMSSGIT--- | |
| Glyma09g06980.1 | (1569) | SLDFVKP--TILNSKPINKDE-----------------TLTLSTTSSSFMSSVT--- | |
| Glyma15g18250.1 | (1571) | SLDFVKP--TILNSKPSNKDE-----------------TLTLSTTSSSFTSSVT--- | |
| Glyma13g00380.1 | (1573) | TLDFAKP--VMLKSNPNPNPSSTDLSVSQYSKTKDTTTSSISPPVSTTTSSFMSSITA--- | |
| Glyma17g06450.1 | (1589) | TLDFAKP--VMVKSNPNPNPSSTDLSVSQYSKTKDTTTFSISPPMSTTTSSFLSSITA--- | |
| GSVIVT01029265001 | (1587) | --LSAK------------PDPLKSEG------------NASVSSTTSSFLSSIT--- | |
| POPTR_0006s07170.1 | (1583) | NLDFVNS------NSPPKAESKNDLSLG------SQYSKD--SLSSGTTSSFVSSVTA--- | |
| POPTR_0018s13600.1 | (1585) | NLDFFKS------NNTFKSETKNDLSFG------SQYSKDCFSSGTTSSFLSSVTA--- | |

Fig. 33D

| | | |
|---|---|---|
| Solyc12g096350.1.1 | (1517) | ------GEATVSNGKQVSSMLLLPPQAVNFPTTGK-----------------------RC |
| LOC_Os08g13840.1 | (1525) | ----------GGDGSVSKGR-----------------SLVSSGKPPLAGGVKRK----HP--HPPC |
| LOC_Os08g13840.2 | (1527) | ----------GGDGSVSKGR-----------------SLVSSGKPPLAGGVKRK----HP--HPPC |
| GRMZM2G071907_T01 | (1529) | ----------GEGSVSKGR-----------------SLMSSGKPPLSG----HK--RKPC |
| GRMZM2G091331_T01 | (1531) | ----------GEGSVSKGR-----------------SLVSSGKPPLSG----HK--RKPC |
| AT2G24570.1 | (1507) | ----------GDGSVSKGS-----SIFLAPAPAVPVTSSGKPPLSG----LPY--RKRC |
| AT4G31550.1 | (1509) | ----------GDGSVSNGKI-----FLASAPLQPVNSSGKPPLAG----HPY--RKRC |
| Eucgr.C04011.1 | (1521) | ----------GDGSVSNGKL-GTSMFIAPASG-PASSAGKPPISS----VPY--KKRC |
| Eucgr.C04011.2 | (1523) | ----------GDGSVSNGKL-GTSMFIAPASG-PASSAGKPPISS----VPY--KKRC |
| clementine0.9_014855m | (1519) | ----------GDGSVSNGKQGGSSIFLAPQA--PAVSAGKPPLAA----QPY--KKRC |
| Glyma14g17730.1 | (1511) | ----------GDGSVSNGKI----FLAP----PATSARKPPAF-------KKRC |
| Glyma17g29190.1 | (1513) | ----------GDGSVSNGKI----FLAP----PATSAGKRPAF-------KKRC |
| Glyma06g08120.1 | (1515) | ----------GDASVSYGKL-GSSLFLTP----PPVSAGKPPLSS----API--KKRC |
| Solyc08g006320.2.1 | (1575) | ----------GEGSVSNGKV-FSSMSLPPR----PPVSSGKPPIAG-------KRC |
| Bradi3g18580.1 | (1581) | CGGGGGEGSVSVSKGQGQ----------------IAISSGKPPLAAGTKRKLQQQLQQQ----QQPC |
| LOC_Os04g51560.1 | (1577) | ----------GEGSVSKGR-----------------SLLSSGKPPLSG----HK--RKPC |
| Bradi5g04817.1 | (1563) | ----------GDGSVSNGRAGVSSSSMVFPPP--PSASCGKPPLAA-----------KHKC |
| LOC_Os04g21950.1 | (1565) | ----------GDGSVSNGRGGGSSSSLMLPPP--PATSCGKPPLSSAAAAMS----AGAGHKRKC |
| GRMZM2G102583_T02 | (1567) | ----------GDGSVSNGRAGGSSSFLMFPPAP-GAASCAKPPPAGA----AQ--KRKC |
| POPTR_0018s03450.1 | (1579) | ----------GDGSVSNGKQGSSI----------FLGSAGKPPLST----VPYSNKKRC |
| Glyma09g06980.1 | (1569) | ----------NDASVSDGKIG---PFLPPS----AAKPPLSS----AH--RKKC |
| Glyma15g18250.1 | (1571) | ----------NDASVSDGKIG---GPFLPP----SAAKPPLSS----AH--RKKC |
| Glyma13g00380.1 | (1573) | ----------DGSVSDGKIGP--------AIIAAGKPPLSS----SH--RKRC |
| Glyma17g06450.1 | (1589) | ----------DGSVSDGKIGP--------AILAAGKPPLSS----SH--RKRC |
| GSVIVT01029265001 | (1587) | ----------GDGSVSNGKLG--TPLFAPPPA-PAVSAGKPPLSS----SQ--RKKC |
| POPTR_0006s07170.1 | (1583) | ----------DGSVSNGKQGGSSLFGT----QARSTGKPPLSS----TH--RKKC |
| POPTR_0018s13600.1 | (1585) | ----------DGSVSDGKQGGSSSLFGT----HPRPTGKPPLSS----IH--RKKC |

Fig. 33E

```
Solyc12g096350.1.1  (1517)  REH-EQSDAISGSKS-TGSGK---CHC----KKRKAKD-RKVIRIPAISTRVAD IPGDEFSW
LOC_Os08g13840.1    (1525)  AAA-GDGHGHGAGHAHGG----CHC---SKKRRKQRV-RRTVRVAAASARVAD IPADEYSW
LOC_Os08g13840.2    (1527)  AAA-GDGHGHGAGHAHAHGG---CHC---SKKRRKQRV-RRTVRVAAASARVAD IPADEYSW
GRMZM2G071907_T01   (1529)  AG-------AHSEATTNGSR---CHC---SKRRKNRV-KRTIRVPAISSKVAD IPSDEYSW
GRMZM2G091331_T01   (1531)  AG-------AHSEATTNGSR---CHC---SKRRKNRV-KRTIRVPAISAKIAD IPPDEYSW
AT2G24570.1         (1507)  FEH-DHSEGFSGKISGSGNGK--CHC---KKSRKNRM-KRTVRVPAVSAKIAD IPPDEYSW
AT4G31550.1         (1509)  LEH-EHSESFSGKVSGSAYGK--CHC---KKSRKNRM-KRTVRVPAISAKIAD IPPDEYSW
Eucgr.C04011.1      (1521)  HEH-DPSDNISGKHSGSGSGK--CHC---SKRRKNRV-KKVTRVPAISNKIAD IPADEFSW
Eucgr.C04011.2      (1523)  HEH-DPSDNISGKHSGSGSGK--CHC---SKRRKNRV-KKVTRVPAISNKIAD IPADEFSW
clementine0.9_014855m (1519) QDHKDHSDDLSGKFSGSTSGNNKCHC---SKRRKNRV-KKTIRVPAISSKIAD IPPDEYSW
Glyma14g17730.1     (1511)  HEHREHSGDVSGNSK--------CHC---VKRRKNRV-KNTVRVPAISSKIAD IPPDEYSW
Glyma17g29190.1     (1513)  HEHREHSDDVSGNSK--------CHC---VKRRKNRV-KSTVRVPAISSKVAD IPPDEYSW
Glyma06g08120.1     (1515)  HDHREHSDEISGKL---SGSSK-CHC---TKRRKNRV-KKTVRVPVISSKIAD IPPDEYSW
Solyc08g006320.2.1  (1575)  RDH-ELSDEFSGRT---SSSGK-CQC----KKRKSRV-KKVIRVPAISSKTAD IPADEYSW
Bradi3g18580.1      (1581)  ASG------AHSDAAAP------CHCASSKKRKSRASRRAVRVPATSARAAD IPGDEFSW
LOC_Os04g51560.1    (1577)  AG-------GHSEATANGGR---CHC---SKRRKNRV-KRTIRVPAISSKIAD IPPDEYSW
Bradi5g04817.1      (1563)  HDH-AHSENVAG----ASGGR--CHC---SKRRKHRV-KRTIRVPAISKAAEIPADDFSW
LOC_Os04g21950.1    (1565)  HDH-AHSENVAGGKYGSTGGR--CHC---SKRRKHRV-KRTIRVPAISKVAD IPADDFSW
GRMZM2G102583_T02   (1567)  HDH-AHSENVAGGKYGANGGR--CHC---SKRRKHRV-KRTIRVPAISPKVAD IPADEYSW
POPTR_0018s03450.1  (1579)  HEH-HHDDTVSG---SSSGK---CHC---SSKRRKNRV-KKTIRVPAISSKIAD IPPDEYSW
Glyma09g06980.1     (1569)  RDA------AAALSAKPS-----CHC---SKKRKSRV-KRTIRVPAISSKIAD IPPDEYSW
Glyma15g18250.1     (1571)  RDA------AAALSTKPS-----CHC---SKKRKSRV-KRTIRVPAVSSKIAD IPSDEYSW
Glyma13g00380.1     (1573)  HDA-TLS---AGKA---SSSAH-CHC---SKRRKSRV-KRMIRVPAISSKIAD IPVDEYSW
Glyma17g06450.1     (1589)  HDA-TLS---AGKA---SSSAH-CHC---SKRRKSRV-KRMIRVPAISSKIAD IPADEYSW
GSVIVT01029265001   (1587)  HEH-GSSDNISGKL--SVSGR--CHC---SKRRKNRV-KRTIRVPAISSKIAD IPADEYSW
POPTR_0006s07170.1  (1583)  HDH-ALS---ARKI---SSGGS-CHC---SKRRKSRV-KRTIRVPAVSSKIAD IPADEYSW
POPTR_0018s13600.1  (1585)  HDH-TLS---TSKIS-SSGGS--CHC---SKRRKSRV-KRTIRVPAISSKVAD IPADEFSW
Consensus (1560,1561)       CXC    xKxRKXxx XxxxRXXXSxXXAXIPxDXXSW
```

Fig. 33F

```
Solyc12g096350.1.1   (1517) RKYGQKPIKGSKYPRGYYKCSSLRGCPARKHVERAMDDPTMLIVTYEDEHCHNPVAAMHG
LOC_Os08g13840.1     (1525) RKYGQKPIKGSPYPRGYYRCSTVKGCPARKHVERAADDPATLVVTYEGDHRH-----SPP
LOC_Os08g13840.2     (1527) RKYGQKPIKGSPYPRGYYRCSTVRGCPARKHVERAADDPATLVVTYEGDHRH-----SPP
GRMZM2G071907_T01    (1529) RKYGQKPIKGSPYPRGYYKCSTVRGCPARKHVERATDDPAMLVVTYEGEHRHTPGA-VQG
GRMZM2G091331_T01    (1531) RKYGQKPIKGSPYPRGYYKCSTVRGCPARKHVERATDDPAMLVVTYEGEHRHTPGAPAPA
AT2G24570.1          (1507) RKYGQKPIKGSPHPRGYYKCSTFRGCPARKHVERALDDSTMLIVTYEGEHRHQSTMQEH
AT4G31550.1          (1509) RKYGQKPIKGSPHPRGYYKCSTFRGCPARKHVERALDDPAMLIVTYEGEHRHNQSAMQEN
Eucgr.C04011.1       (1521) RKYGQKPIKGSPFPRGYYKCSTMRGCPARKHVERAPDDPTMLIVTYEGEHRH-SQSASQE
Eucgr.C04011.2       (1523) RKYGQKPIKGSPFPRGYYKCSTMRGCPARKHVERAPDDPTMLIVTYEGEHRH-SQSASQE
clementine0.9_014855m (1519) RKYGQKPIKGSPYPRGYYKCSTMRGCPARKHVERAPDDPAMLIVTYEGEHRHSQAAMQEN
Glyma14g17730.1      (1511) RKYGQKPIKGSPYPRGYYKCSTVRGCPARKHVERAPDDPAMLIVTYEGEHRHAVQAAMQE
Glyma17g29190.1      (1513) RKYGQKPIKGSPYPRGYYKCSTVRGCPARKHVERAPDDPAMLIVTYEGEHRHAVQAAMQE
Glyma06g08120.1      (1515) RKYGQKPIKGSPYPRGYYKCSSVRGCPARKHVERAPDDPTMLIVTYEGEHRH--SMQEN
Solyc08g006320.2.1   (1575) RKYGQKPIKGSPYPRGYYRCSSVRGCPARKHVERATDDPGMLVVTYGGEHRHVQTTISGN
Bradi3g18580.1       (1581) RKYGQKPIKGSPYPRGYYKCSTVKGCPARKHVERATDDPAMLVVTYEGDHRH--GADLPA
LOC_Os04g51560.1     (1577) RKYGQKPIKGSPYPRGYYKCSTVRGCPARKHVERATDDPAMLVVTYEGEHRHTPGPLPAP
Bradi5g04817.1       (1563) RKYGQKPIKGSPYPRGYYKCSTVRGCPARKHVERDPSEPSMLIVTYEGDHRHAPADQEPP
LOC_Os04g21950.1     (1565) RKYGQKPIKGSPYPRGYYKCSTLRGCPARKHVERDPTDPSMLIVTYEGEHRHSPSAAGQD
GRMZM2G102583_T02    (1567) RKYGQKPIKGSPYPRGYYKCSTVRGCPARKHVERDPADPSMLIVTYEGEHRHSPASGQDP
POPTR_0018s03450.1   (1579) RKYGQKPIKGSPYPRGYYKCSTVRGCPARKHVERATDDPAMLIVTYEGEHCH-TQGAMEG
Glyma09g06980.1      (1569) RKYGQKPIKGSPYPRGYYKCSTVRGCPARKHVERAQDDPKMLIVTYEGEHRH-----VLP
Glyma15g18250.1      (1571) RKYGQKPIKGSPYPRGYYKCSTVRGCPARKHVERAQDNPKMLIVTYEGEHRH-----VLP
Glyma13g00380.1      (1573) RKYGQKPIKGSPYPRGYYKCSTVRGCPARKHVERAQDDPNMLIVTYEGEHRH-PQPRLPE
Glyma17g06450.1      (1589) RKYGQKPIKGSPYPRGYYKCSTVRGCPARKHVERAQDDPNMLIVTYEGEHRH-PQPRLPE
GSVIVT01029265001    (1587) RKYGQKPIKGSPYPRGYYKCSTVRGCPARKHVERAPDDPAMLIVTYEGEHRH----SQT
POPTR_0006s07170.1   (1583) RKYGQKPIKGSPYPRGYYKCSSVRGCPARKHVERAVDDSAMLIVTYEGEHRHSHTPLPGD
POPTR_0018s13600.1   (1585) RKYGQKPIKGSPYPRGYYKCSSVRGCPARKHVERAVDDPAMLIVTYEGEHRHSHAPLPEN
Consensus            (1561) RKYGQKPIKGSxxPRGYYxCSxxxGCPARKHVERAxDxxxxLxVTYExxHxH
```

Fig. 33G

| | | |
|---|---|---|
| Solyc12g096350.1.1 | (1517) | NSSQ----------MVNFGLMEKK---------- |
| LOC_Os08g13840.1 | (1525) | PPPLV----------------------------- |
| LOC_Os08g13840.2 | (1527) | PPPLV----------------------------- |
| GRMZM2G071907_T01 | (1529) | PSPLATASPVPVAVSAGNGLVV------------ |
| GRMZM2G091331_T01 | (1531) | PSPLAAAS------PV-PASAAAAVSAGNNGLV |
| AT2G24570.1 | (1507) | VTPSVSG-------LV-FGSA------------- |
| AT4G31550.1 | (1509) | ISSSGIND------LV-FASA------------- |
| Eucgr.C04011.1 | (1521) | IVPAGAMN------LV-FKST------------- |
| Eucgr.C04011.2 | (1523) | IVPGG----------------------------- |
| clementine0.9_014855m | (1519) | AAPAGVG-------LV-FEST------------- |
| Glyma14g17730.1 | (1511) | NAAGVVG-------LV-FEST------------- |
| Glyma17g29190.1 | (1513) | NAAGVVG-------LV-FEST------------- |
| Glyma06g08120.1 | (1515) | ISGGVGLG----------FEST------------ |
| Solyc08g006320.2.1 | (1575) | VTGAGAGSSGERMMAFELTGQKNGERLGLEI |
| Bradi3g18580.1 | (1581) | PAAN------------------------------ |
| LOC_Os04g51560.1 | (1577) | PAAAAVAAMPVSVA-VSTGNGHV----------- |
| Bradi5g04817.1 | (1563) | PPPLAALH------EL------------------ |
| LOC_Os04g21950.1 | (1565) | HPPAPPPP------LA-LPLA------------- |
| GRMZM2G102583_T02 | (1567) | PPPSLAP-------IPELPSH------------- |
| POPTR_0018s03450.1 | (1579) | NMAAGTVN------LV-FESTMMVGE-------- |
| Glyma09g06980.1 | (1569) | LTSAAGVS----------FGH------------- |
| Glyma15g18250.1 | (1571) | LTAAAGVS----------FGH------------- |
| Bradi13g00380.1 | (1573) | TAAGAGGTFAAHPV-------------------- |
| Glyma17g06450.1 | (1589) | TSAGAAADFVSQPV-------------------- |
| GSVIVT01029265001 | (1587) | PAPAGGLM----------FPST------------ |
| POPTR_0006s07170.1 | (1583) | VTASAAMR------HV-FHST------------- |
| POPTR_0018s13600.1 | (1585) | VTANAAMR------HV-FQST------------- |

Fig. 33H

```
LOC_Os03g17150.1     (1692) ------------MAYGKRPRQQAEEAAFSLFDSSDMARI-MLLFSGAHGGGG---
Bradi2g54470.1       (1688) ----------------MSKRGRGVWE--------MDTARV-LMLLAQHHQHQQ---
LOC_Os01g62130.1     (1690) --------------MSKRSRSMWDMQEFVGSVDTARV-LMLLAQQSQHGL-L
AT3G46070.1          (1652) -------------------MVAESDNRD-----LTVDTAASC-LMLLSGIGEHDG---
AT5G59820.1          (1658) ---------------MVAISEIKSTVD-------VTAANC-LMLLSRVGQENV---
AT3G46080.1          (1654) ---------------MVARSEEVE-------IVEDTAAKC-LMLLSRVGECGG---
AT3G46090.1          (1656) ---------------MVARSEEIVI------VEEDTTAKC-LMLLSRVGECGG---
AT2G28710.1          (1650) ---------------MERGRSDME-------MINNMANC-LILLSKAHQNDT-K
Solyc11g073060.1.1   (1686) ----------------MTTMKRSREDNG---QVEAEAMANCALMLLSRLNNNND-
Glyma15g04570.1      (1660) ----------------MKRGREESK--------LDMANC-LMLLTKVGESETNY
POPTR_0001s24250.1   (1682) ----------------MKRDREQAE--------IDLAKC-LMLLSKVGQADHEI
POPTR_0009s03280.1   (1684) --------------MSSITMKRGREEGE------LDMANC-LMLLYKVGKADD-H
clementine0.9_024203m (1662) ----------------MKRDRE---------MAAIDTANC-LMLLSKVGETDQ--
Eucgr.B02398.1       (1678) ----------------MVKRDREDAE-------VEALAVANC-LMLLPRVGECAD--
Eucgr.B02399.1       (1680) ----------------MVKRDREDTE-------VEALALANC-LMLLSRVGESTDSP
Eucgr.B02397.1       (1676) ----------------MVKRDREDTE-------VEALAVANS-LMLLSRVERI----
Eucgr.B02395.1       (1674) SKRRNQKNQTLQFHILYYRIPEMVKRDREDTE-----VEALAVANS-LMLLSRVGQSSD--
Eucgr.B02390.1       (1664) ----------LPEMVKRDREDTE-------VEALARVNC-LMLLSRVGESTDSA
Eucgr.B02392.1       (1666) ----------------MVKRDREDTE-------VEALARANC-LMLLSRVGESTDSA
Eucgr.B02394.1       (1668) ----------------MVKRDREDTE-------VEALAVANS-LMLLSRIGRSTD--
Eucgr.B02396.1       (1670) ----------------MVKRDREDME-------VEALAVANS-LMLLSRVGQSTD--
Eucgr.L02150.1       (1672) ----------------MVKRDREDME-------VEALAVANS-LMLLSRVGQSTD--
AT3G53600.1          (1593) ----------------MKRDRSDYE--ESMKHIDIVES-LMMLSRSFVVKQ-I
AT2G37430.1          (1591) ----------------MKRERSDFE--ESLKNIDIAKC-LMILAQTSMVKQ-I
clementine0.9_035547m (1611) ----------MAVKGGLANGE----IAERLALANC-LMLLTRSNRAK--L
Eucgr.A01230.1       (1613) ----------------MKRTRDDYE---RMSLDMAKC-LMLLSHGVNAEL-K
Eucgr.A01232.1       (1617) ----------------MMKRSRDDYE---RMNLDMAKC-LMLLTHGVNANP-K
Eucgr.A01231.1       (1615) -----------------------MAKC-LMLLSHGVNTNP-K
Glyma10g05190.1      (1607) ----------------MKRHRENEG--TTLESWGMQNC-SISITPDTTSV--
Glyma13g19560.1      (1609) ----------------MKRQRENEV--TTLESWDMQIC-STSITPDTSVS--
Glyma10g05180.1      (1599) ----------------MKRQRDGVE--SIDLVNC-LMLLSHHREIK-----
Glyma13g19550.1      (1601) --------------------TRDGEE----NIDLGNC-LLILSHPREIK---
Glyma10g05210.1      (1603) ----------MVAILKRQGENES---EETIIGLAKS-LMQLSRVQQQSN-K
Glyma13g19570.1      (1605) ----------MVAILKRQRETEA---EESIIRLAES-LMQLSRVQQKS--K
Glyma03g33050.1      (1595) ----------------MKRQRDFEG----FESIDLANC-LMMLSHPQQNK--K
Glyma19g35740.1      (1597) ----------------MKRQRDFKG----FESIDLANC-LMMLSHPQQNE--K
```

ZAT11 clade

Fig. 36A

Fig. 36B

```
LOC_Os03g17150.1    (1692) -GAAAASPPE------------RMFECKTCNRQFPSFQALGGHRASH-KKPR-LA----
Bradi2g54470.1      (1688) -QQQQQAPLAM-----------RGRVFECKICSRQFPTFQALGGHRASH-KRPRLLQ---
LOC_Os01g62130.1    (1690) GGGGFAAGAQPVVVRGG-----AHDRVFECKTCNRQFPTFQALGGHRASH-KRPR-QQ---
AT3G46070.1         (1652) ----RKK---------------RVFRCKTCERDFDSFQALGGHRASHSKLTN-SD-----
AT5G59820.1         (1658) ----DGGDQK------------RVFTCKTCLKQFHSFQALGGHRASH-KKPN--------
AT3G46080.1         (1654) ----GGEK--------------RVFRCKTCLKEFSSFQALGGHRASH-KK----LI----
AT3G46090.1         (1656) ----GCGGDE------------RVFRCKTCLKEFSSFQALGGHRASH-KK----LI----
AT2G28710.1         (1650) SRV-------------------FACKTCNKEFPSFQALGGHRASH-RRSA-AL-------
Solyc11g073060.1.1  (1686) ----------------------FACKTCNKRFPSFQALGGHRTSHNKKPK-LL-------
Glyma15g04570.1     (1660) PISKGSDIGD------------FKCKTCNRRFSSFQALGGHRASH-KKKPKLMV------
POPTR_0001s24250.1  (1682) LTNYRSAAAAAATAGAGAGAGRSFSCKTCNKNFPSFQALGGHRASH-KKKPK-LK------
POPTR_0009s03280.1  (1684) ELPTNYKSSSP-----S-----CAGRLFSCKTCNKNFSSFQALCGHRASH-KKKPK-LV--
clementineC.9_024203m (1662) ----------------------GKRVFACKTCNKEFPSFQALGGHRASH-KKPK-LMTMAS
Eucgr.B02398.1      (1678) -SNRESRSTE------------RMFACKTCNREFSSFQALGGHRTSH-KKQK-LI-----
Eucgr.B02399.1      (1680) WLNHKSRPTE------------FACKTCNREFSSFQALGGHRASH-KKPK-L--------
Eucgr.B02397.1      (1676) ----------------------FACKTCNREFSSFQALGGHRASH-KKPK-LI-------
Eucgr.B02395.1      (1674) -SNCKSWPTE------------RMFACKTCNREFSSFQALGGHRASH-KKPK-LI-----
Eucgr.B02390.1      (1664) SPDRKSRPTE------------RMFACKTCNRFSSFQALGGHKASH-KKPK-LI------
Eucgr.B02392.1      (1666) SLDRKSHPTE------------RMFACKTCNREFSSFQALGGHKASH-KKPK-LI-----
Eucgr.B02394.1      (1668) -SNRKSRPTE------------RMFTCKTCNREFSSFQALGGHRASH-KKPK-LI-----
Eucgr.B02396.1      (1670) -SNRKWQPTE------------RMFTCKTCNREFSSFQALGGHRASH-KKPK-LI-----
Eucgr.L02150.1      (1672) -SNCKWQPTE------------RMFACKTCNREFSSFQALGGHRASH-KKPK-LI-----
AT3G53600.1         (1593) DVKQSTGSKTN-----------HNNHFECKTCNRKFDSFQALGGHRASH-KKPK-LI---
AT2G37430.1         (1591) GLNQHTESHTS-----------NQFECKTCNRKFSSFQALGGHRASH-KKPK-LT-----
clementineC.9_035547m (1611) PIKKRLASDV------------FKCKTCNRQFPSFQALGGHRASH-KKPK-LI-------
Eucgr.A01230.1      (1613) RAAVHQTEDN------------YECKTCNRQFSSFQALGGHRASH-KKPK-LL-------
Eucgr.A01232.1      (1617) TAAVHHEDN-------------FKCKTCNRQFSSFQALGGHRASH-KKPK-LL-------
Eucgr.A01231.1      (1615) KAAVHHDEDN------------FECKTCNRRFSSFQALGGHRASH-KKPR-LL-------
Glyma10g05190.1     (1607) -SSSTTSPEE------------VFECKTCNRKFNSFQALGGHRASHNKRVE-ME------
Glyma13g19560.1     (1609) --SSTISPED------------VFECKTCNRKFNSFQALGGHRACHNKRVK-ME------
Glyma10g05180.1     (1599) -PQKLLGPEE------------FECMTCNRKFTSFQALGGHRASH-KKPK-LHV------
Glyma13g19550.1     (1601) -PQKLLGPKE------------FECMTCNLKFSSFQALGGHRASH-KKPK-LYV------
Glyma10g05210.1     (1603) PLLKTFSPTE------------FECKTCNRKFPSFQALGGHRASH-KKPK-FE-------
Glyma13g19570.1     (1605) PLLKTFSPTE------------FECKTCNRKFPSFQALGGHRASH-KKPK-FE-------
Glyma03g33C50.1     (1595) LLQTKIEAVK------------FECKTCNRKFSSFQALGGHRASH-KRSK-LE-------
Glyma19g35740.1     (1597) LLQKKIEAVE------------FECKTCNRKFSSFQALGGHRASH-KRSK-LE-------
Consensus           (1646)                       xxCxTCNxxFxSFQALGGHRAxHxxx
```

ZAT11 clade (bracket marking last 16 rows from AT3G53600.1 through Glyma19g35740.1)

| Sequence | Start | Sequence Region 1 | Region 2 | Region 3 (ZAT11 clade) |
|---|---|---|---|---|
| LOC_Os03g17150.1 | (1692) | DGDPAAEA—————————————— | ——————————PAKPKVHGCSICGLEFAVGQALGGHMR | |
| Bradi2g54470.1 | (1688) | QQQQPQNALVNDAAALCLGRQITLPRQPQQMPVPAKPRAHECPVCGLEFAVGQALGGHMR | | |
| LOC_Os01g62130.1 | (1690) | QQHALGGGAGADDAGLCLGRQPTPPR——— | ——PQPAKPRVHECPVCGLEFPIGQALGGHMR | |
| AT3G46070.1 | (1652) | DKSLPGSPK————KKPKT————— | ————TTTTAHTCPICGLEFPMGQALGGHMR | |
| AT5G59820.1 | (1658) | ————NDALS————SGLMK————— | ————KVKTSSHPCPICGVEFPMGQALGGHMR | |
| AT3G46080.1 | (1654) | NSSDPSLLG————SLSNKK———— | ————TKTATSHPCPICGVEFPMGQALGGHMR | |
| AT3G46090.1 | (1656) | NSDNPSLLG————SLSN—————— | ————KKTKTSHPCPICGVKFPMGQALGGHMR | |
| AT2G28710.1 | (1650) | EGHAPPSPK———————————— | ————RVKPVKHECPICGAEFAVGQALGGHMR | |
| Solyc11g073060.1.1 | (1686) | GET————————————————— | ————NQKSKVHKCSICGMEFALGQALGGHMR | |
| Glyma15g04570.1 | (1660) | TDLSCHQEL————PNPTM————— | ————KQQPRMHPCPICGLEFAIGQALGGHMR | |
| POPTR_0001s24250.1 | (1682) | ESTGNLLKL————PNS—————— | ————PSKPKTHQCSICGLEFPLGQALGGHMR | |
| POPTR_0009s03280.1 | (1684) | GSTGNLLMK————LPNS————— | ————PPKPKNHQCSICGLEFPIGQALGGHMR | |
| clementine0.9_024203m | (1662) | SGEDFDQAQ————MPPAS———— | ————PKKPKTHECSICGLEFAIGQALGGHMR | |
| Eucgr.B02398.1 | (1678) | PGGLFHLGC————TADSS———— | ————PAKPKRHECSICGLEFPMGQALGGHMR | |
| Eucgr.B02399.1 | (1680) | SGDLFHLGR————TADSS———— | ————PAKPKTHECAICGLEFPLGQALGGHMR | |
| Eucgr.B02397.1 | (1676) | SGDLLHLGH————SVDSS———— | ————LDKPKMHKCSICGLEFPLGQALGGHMR | |
| Eucgr.B02395.1 | (1674) | SGDLFHLGH————AADSS———— | ————QAKPKTHECSICGLDFPIGQALGGHMR | |
| Eucgr.B02390.1 | (1664) | SGDLFHLGH————AADSS———— | ————PAKPKTHECSICGLDFPMGQALGGHMR | |
| Eucgr.B02399.1 | (1680) | | | |
| Eucgr.B02392.1 | (1666) | SGDLFHLGH————AADSS———— | ————PAKPKTHECSICGLDFPLGQALGGHMR | |
| Eucgr.B02394.1 | (1668) | SGDLRLLGR————TADSS———— | ————PAKLKMHECSICGLDFPTGQALGGHMR | |
| Eucgr.B02396.1 | (1670) | SGDLLRLGH————EADSS———— | ————PAKPKTHECPICGLDFPIGQALGGHMR | |
| Eucgr.L02150.1 | (1672) | SGDLLRLGH————EADSS———— | ————PAKPKTHECPICGLDFPIGQALGGHMR | |
| AT3G53600.1 | (1593) | VDQEQVKHR————HLSND———— | ————NKENDMHKCTICDQMFGTGQALGGHMR | |
| AT2G37430.1 | (1591) | ——VEQKDVK————TT———————— | ————YKGNHFHKCSICSQSFGTGQALGGHMR | |
| clementine0.9_035547m | (1611) | NGETKTLSS——————————— | ————ATKPKLHECSICGQEFAMGQALGGHMR | |
| Eucgr.A01230.1 | (1613) | QNKPGDCTK————LALGG———— | ————TAETKMHECSVCGLKFALGQALGGHMR | |
| Eucgr.A01232.1 | (1617) | ETKPEDSTK————SVLGT———— | ————TANPKMHECSICGLKFSLGQALGGHMR | |
| Eucgr.A01231.1 | (1615) | ETTKLEDCT———K-LALGS——— | ————MAKPKMHECSMCGLKFASGQALGGHMR | |
| Glyma10g05190.1 | (1607) | GEEQQLKLK-NKGKIYGLGK—— | ————QSEPKITHNCFICGQGFSLGQALGGHMR | |
| Glyma13g19560.1 | (1609) | GEEQQLKTR-AKYLGLGK———— | ————HSEPKMHNCSICGQGFSLGQALGGHMR | |
| Glyma10g05180.1 | (1599) | KEQGKILML————————————— | ————GNKPKHECTICGREFTLGQALGGHMR | |
| Glyma13g19550.1 | (1601) | KEQCKILML————————————— | ————RNKPKHECSICGREFTLGQALGGHMR | |
| Glyma10g05210.1 | (1603) | AEELKEEAK————————————— | ————KTKPKMHECSICGMEFSLGQALGGHMK | |
| Glyma13g19570.1 | (1605) | GEELKEEAK———-KGLSL———— | ————GNKPKMHECSICGMEFSLGQALGGHMR | |
| Glyma03g33050.1 | (1595) | GDELKAHAI———-SLSL————— | ————GNKPKMHECSICGQEFSLGQALGGHMR | |
| Glyma19g35740.1 | (1597) | GDHELKAHA———-ISLSL———— | ————ANKPKMHECSICGQEFSLGQALGGHMR | |
| Consensus | (1647) | | | HxCxxCxxxFxxGQALGGHMX |

```
LOC_Os03g17150.1      (1692) NAP-AI-EEEPDRA-RPAGLAVEFPVVVDFPC----------------
Bradi2g54470.1        (1688) NLT-PS-ENCAKCRSVAAG--LGARQGVPKALAMLDCSL
LOC_Os01g62130.1      (1690) NLT-PS-ENRAKCR-NVVGL-GAGGQGVHKALAMLDCFL
AT3G46070.1           (1652) DLT-SV-ESFVNTE-LELGR-TMY---------------
AT5G59820.1           (1658) SLG-MV-DNL-NLK-LELGR-TVY---------------
AT3G46080.1           (1654) DSM---ESLVNWK-LELGR-TIS----------------
AT3G46090.1           (1656) DLD-SM-ESLVNWK-LELGR-TISWS-------------
AT2G28710.1           (1650) NLT-PL-ENE-DLK-LELGR-FIF----------------
Solyc11g073060.1.1    (1686) NIT-PN-VD--DLK-LWPIE-EAPSPVLRIFF
Glyma15g04570.1       (1660) NLT-PLEED--DLK-LNLRT---PVLNCFI
POPTR_0001s24250.1    (1682) SLALPMYQN--DSE-LQLEK-VDRPMLRCFI
POPTR_0009s03280.1    (1684) SLALPMDQN--ESE-LQLRK-AGTRPVLKCFI
clementine0.9_024203m (1662) NLM-PT-GD--DLK-LWVA---------------------
Eucgr.B02398.1        (1678) NSS-LM-ED--DLT-LRLGK-VAPPLVLDLLL
Eucgr.B02399.1        (1680) NSS-PT-ED--DLT-LRLGK-AAPPLVLDLVL
Eucgr.B02397.1        (1676) NSS-PM-ED--DLT-LRLGK-FAPPLALDLVL
Eucgr.B02395.1        (1674) NSS-PT-ED--DLT-LRLGK-VTPPLALDLVL
Eucgr.B02390.1        (1664) NSL-PM-ED--DLT-LRLGK-VAPPLVLDLVL
Eucgr.B02392.1        (1666) NSL-PM-QD--DLT-LRLGK-VAPPIVLDLVL
Rucgr.R02.394.1       (1668) NSL-PM-FD--DLT-LRLGK-VAPPIVPDIVL
Eucgr.B02396.1        (1670) NSS-PM-ED--DLT-LRLGK-VAPPLVLDLVL
Eucgr.L02150.1        (1672) NSS-PM-ED--DLT-LRLGK-VAPPLVLDLVL
AT3G53600.1           (1593) NLT-PL-EN--DLV-LIFGKNLVPQIDLKFVN
AT2G37430.1           (1591) NLT-PL-EN--DLE-YIFGKTFVPKIDMKFVL
clementine0.9_035547m (1611) NLT-PL-EN--DLE-ALFGK-MVPKVDLLMT
Eucgr.A01230.1        (1613) NLT-PL-EN--DLK-FLFGK-MYPRTVAFS
Eucgr.A01232.1        (1617) NLT-PL-EN--DLK-FLFGK-MAPEIDALLL
Eucgr.A01231.1        (1615) NLS-PL-EN--DLK-FLFGK-MAPKIDPVFL
Glyma10g05190.1       (1607) NLS-PL-EN--DLKLLLFGK-VSPKVNPSSF
Glyma13g19560.1       (1609) NLT-PL-EN--DLKLLLFGK-LSPKVNLSSF
Glyma10g05180.1       (1599) NLT-PL-QN--DLK-LLFGE-KAPK-------
Glyma13g19550.1       (1601) NLT-PL-QN--DLK-LLFGD-KAPKKNKSIFYHNKNASS
Glyma10g05210.1       (1603) NLT-PL-EN--DLK-LLFGN-KAPRVDLSL
Glyma13g19570.1       (1605) NLT-PL-EN--DLK-LLFGN-KAPRVDLSL
Glyma03g33050.1       (1595) NLT-PF-EN--DLK-LLFGK-MAPNSGALVDSL
Glyma19g35740.1       (1597) NLT-PL-EN--DLK-LLFGK-MAPNAGAFA
Consensus             (1648) NLX PX XN  DLxXxxFG
```

ZAT11 clade (bracket grouping the lower entries)

PHOTOSYNTHETIC RESOURCE USE EFFICIENCY IN PLANTS EXPRESSING REGULATORY PROTEINS

FIELD OF THE INVENTION

The present invention relates to plant genomics and plant improvement.

BACKGROUND OF THE INVENTION

A plant's phenotypic characteristics that enhance photosynthetic resource use efficiency may be controlled through a number of cellular processes. One important way to manipulate that control is by manipulating the characteristics or expression of regulatory proteins, proteins that influence the expression of a particular gene or sets of genes. For example, transformed or transgenic plants that comprise cells with altered levels of at least one selected regulatory polypeptide may possess advantageous or desirable traits, and strategies for manipulating traits by altering a plant cell's regulatory polypeptide content or expression level can result in plants and crops with commercially valuable properties. Examples of such trait manipulation include:

Increasing Canopy Photosynthesis to Increase Crop Yield.

Recent studies by crop physiologists have provided evidence that crop-canopy photosynthesis is correlated with crop yield, and that increasing canopy photosynthesis can increase crop yield (Long et al., 2006. *Plant Cell Environ.* 29:315-33; Murchie et al., 2009 *New Phytol.* 181:532-552; Zhu et al., 2010. *Ann. Rev. Plant Biol.* 61:235-261). Two overlapping strategies for increasing canopy photosynthesis have been proposed. The first recognizes great potential to increase canopy photosynthesis by improving multiple discrete reactions that currently limit photosynthetic capacity (reviewed in Zhu et al., 2010. supra). The second focuses upon improving plant physiological status during environmental conditions that limit the realization of photosynthetic capacity. It is important to distinguish this second goal from recent industry and academic screening for genes to improve stress tolerance. Arguably, these efforts may have identified genes that improve plant physiological status during severe stresses not typically experienced on productive acres (Jones, 2007. *J. Exp. Bot.* 58:119-130; Passioura, 2007. *J. Exp. Bot.* 58:113-117). In contrast, improving the efficiency with which photosynthesis operates relative to the availability of key resources of water, nitrogen and light, is thought to be more appropriate for improving yield on productive acres (Long et al., 1994. *Ann. Rev. Plant Physiol. Plant Molec. Biol.* 45:633-662; Morison et al., 2008. *Philosophical Transactions of the Royal Society B: Biological Sciences* 363:639-658; Passioura, 2007, supra).

Increasing Nitrogen Use Efficiency (NUE) to Increase Crop Yield.

There has been a large increase in food productivity over the past 50 years causing a decrease in world hunger despite a significant increase in population (Godfray et al., 2010. *Science* 327:812-818). A significant contribution to this increased yield was a 20-fold increase in the application of nitrogen fertilizers (Glass, 2003. *Crit. Rev. Plant Sci.* 22:453-470). About 85 million to 90 million metric tons of nitrogen are applied annually to soil, and this application rate is expected to increase to 240 million metric tons by 2050 (Good et al., 2004. *Trends Plant Sci.* 9:597-605). However, plants use only 30 to 40% of the applied nitrogen and the rest is lost through a combination of leaching, surface run-off, denitrification, volatilization, and microbial consumption (Frink et al., 1999. *Proc. Natl. Acad. Sci. USA* 96:1175-1180; Glass, 2003, supra; Good et al., 2004, supra; Raun and Johnson, 1999. *Agron. J.* 91:357-363). The loss of more than 60% of applied nitrogen can have serious environmental effects, such as groundwater contamination, anoxic coastal zones, and conversion to greenhouse gases. In addition, while most fertilizer components are mined (such as phosphates), inorganic nitrogen is derived from the energy intensive conversion of gaseous nitrogen to ammonia. Thus, the addition of nitrogen fertilizer is typically the highest single input cost for many crops, and since its production is energy intensive, the cost is dependent on the price of energy (Rothstein, 2007. *Plant Cell* 19:2695-2699). With an increasing demand for food from an increasing human population, agriculture yields must be increased at the same time as dependence on applied fertilizers is decreased. Therefore, to minimize nitrogen loss, reduce environmental pollution, and decrease input cost, it is crucial to develop crop varieties with higher nitrogen use efficiency (Garnett et al., 2009. *Plant Cell Environ.* 32:1272-1283; Hirel et al., 2007. *J. Exp. Bot.* 58:2369-2387; Lea and Azevedo, 2007. *Ann. Appl. Biol.* 151:269-275; Masclaux-Daubresse et al., 2010. *Ann. Bot.* 105:1141-1157; Moll et al., 1982. *Agron. J.* 74:562-564; Sylvester-Bradley and Kindred, 2009. *J. Exp. Bot.* 60:1939-1951).

Improving Water Use Efficiency (WUE) to Improve Yield.

Freshwater is a limited and dwindling global resource; therefore, improving the efficiency with which food and biofuel crops use water is a prerequisite for maintaining and improving yield (Karaba et al., 2007. *Proc. Natl. Acad. Sci. USA.* 104:15270-15275). WUE can be used to describe the relationship between water use and crop productivity over a range of time integrals. The basic physiological definition of WUE equates the ratio of photosynthesis (A) to transpiration (T) at a given moment in time, also referred to as transpiration efficiency. However, the WUE concept can be scaled significantly, for example, over the complete lifecycle of a crop, where biomass or yield can be expressed per cumulative total of water transpired from the canopy. Thus far, the engineering of major field crops for improved WUE with single genes has not yet been achieved (Karaba et al., 2007. supra). Regardless, increased yields of wheat cultivars bred for increased transpiration efficiency (the ratio of photosynthesis to transpiration) have provided important support for the proposition that crop yield can be increased over broad acres through improvement in crop water-use efficiency (Condon et al., 2004. *J. Exp. Bot.* 55:2447-2460).

Estimates of water-use efficiency integrated over the life of plant tissues can be derived from analysis of the ratio of the $^{13}C$ carbon isotope to the $^{12}C$ carbon isotope in those tissues. The theory that underlies this means to estimating WUE is that during photosynthesis, incorporation of $^{13}C$ into the products of photosynthesis is slower than the lighter isotope $^{12}C$. Effectively, $^{13}C$ is discriminated against relative to $^{12}C$ during photosynthesis, an effect that is integrated over the life of the plant resulting in biomass with a distinct $^{13}C/^{12}C$ signature. Of the many steps in the photosynthetic process during which this discrimination occurs, discrimination at the active site of Rubisco is of most significance, a consequence of kinetic constraints associated with the $^{13}CO_2$ molecule being larger. Significantly, the discrimination by Rubisco is not constant, but varies depending on the $CO_2$ concentration within the leaf. At high $CO_2$ concentration discrimination by Rubisco is highest, however as $CO_2$ concentration decreases discrimination decreases. Because the $CO_2$ concentration within the leaf is overwhelmingly dependent on the balance between $CO_2$ influx through the stomatal pore and the rate of photosynthesis, and because the stomatal pore controls the rate of transpiration from the leaf, the $^{13}C/^{12}C$ isotopic signature of plant material provides an integrated record of the balance between transpiration and photosynthesis during the life of the plant and as such a surrogate measure of water-use efficiency (Farquhar et al. 1989. *Annu. Rev. Plant Physiol. Plant Mol. Biol.* 40:503-537).

With these needs in mind, new technologies for yield enhancement are required. In this disclosure, a phenotypic screening platform that directly measures photosynthetic capacity, water use efficiency, and nitrogen use efficiency of mature plants was used to discover advantageous properties conferred by ectopic expression of the described regulatory proteins in plants.

SUMMARY

The instant description is directed to a transgenic plant or plants that have greater photosynthetic resource use efficiency with respect to a control plant, or a plant part derived from such a plant, e.g., shoot vegetative organs/structures (e.g., leaves, stems and tubers), roots, flowers and floral organs/structures (e.g., bracts, sepals, petals, stamens, carpels, anthers and ovules), seed (including embryo, endosperm, and seed coat) and fruit (the mature ovary), plant tissue (e.g., vascular tissue, ground tissue, and the like), pulped, pureed, ground-up, macerated or broken-up tissue, and cells (e.g., guard cells, egg cells, etc.). In this regard, the transgenic plant or plants comprise at least one recombinant nucleic acid construct (which may also be referred to as a recombinant construct or recombinant polynucleotide) that comprises a promoter of interest. The recombinant construct or constructs also encode a polypeptide that has a least one conserved domain, wherein the polypeptide expressed from the construct confers an improved trait (for example, greater yield, enhanced photosynthetic resource use efficiency, or improved water us efficiency) to the transgenic plant as compared to a control plant that does not contain the recombinant construct. The promoter and the nucleic acid sequence that encodes the polypeptide may be located in the same single construct, in which case the promoter is part of a cis-acting regulatory sequence that directly drives expression of the polypeptide. Alternatively, the promoter and the nucleic acid sequence that encodes the polypeptide may be located on separate constructs, in which case the promoter drives the expression of a trans-regulatory element and expression of the nucleic acid sequence occurs via transactivation. The choice of promoter may include a constitutive promoter or a promoter with enhanced activity in a tissue capable of photosynthesis (also referred to herein as a "photosynthetic promoter" or a "photosynthetic tissue-enhanced promoter") such as a leaf tissue or other green tissue. Examples of photosynthetic promoters include for example, an RBCS3 promoter (SEQ ID NO: 1693), an RBCS4 promoter (SEQ ID NO: 1694) or others such as the At4g01060 promoter (SEQ ID NO: 1695), the latter regulating expression in a guard cell. The promoter regulates a polypeptide that is encoded by the recombinant polynucleotide or by a second (or target) recombinant polynucleotide (in which case expression of the polypeptide may be regulated by a trans-regulatory element). The promoter may also regulate expression of a polypeptide to an effective level of expression in a photosynthetic tissue, that is, to a level that, as a result of expression of the polypeptide to that level, improves photosynthetic resource use efficiency in a transgenic plant relative to a control plant. The recombinant polynucleotide may comprise the promoter and also encode the polypeptide or alternatively, the polynucleotide may comprise the promoter and drive expression of the polypeptide that is encoded by the second recombinant polynucleotide. In a preferred embodiment, the polypeptide comprises SEQ ID NO: 1369, 1507, 864, 1016, 2, 490, 307, 1156, 1591, 735, 625, or 135, or a sequence that is homologous, paralogous or orthologous to SEQ ID NO: 1369, 1507, 864, 1016, 2, 490, 307, 1156, 1591, 735, 625, or 135, being structurally-related to SEQ ID NO: 1369, 1507, 864, 1016, 2, 490, 307, 1156, 1591, 735, 625, or 135 and having a function similar to SEQ ID NO: 1369, 1507, 864, 1016, 2, 490, 307, 1156, 1591, 735, 625, or 135, as described herein. Expression of the polypeptide under the regulatory control of the constitutive or leaf-enhanced or photosynthetic tissue-enhanced promoter in the transgenic plant confers greater photosynthetic resource use efficiency to the transgenic plants, and may ultimately increase yield that may be obtained from the plants.

The instant description also pertains to methods for increasing photosynthetic resource use efficiency in, or increasing yield from, a plant or plants including the method conducted by growing a transgenic plant comprising and/or transformed with an expression cassette comprising the recombinant polynucleotide that comprises a constitutive promoter or a promoter expressed in photosynthetic tissue, which may be a leaf-enhanced or green tissue-enhanced promoter, such as for example, the RBCS3, RBCS4 or At4g01060 (SEQ ID NO: 1693, 1694, or 1695, respectively), or another photosynthetic tissue-enhanced promoter. Examples of photosynthetic tissue-enhanced promoters are found in the sequence listing or in Table 22. The promoter regulates expression of a polypeptide that comprises SEQ ID NO: 1369, 1507, 864, 1016, 2, 490, 307, 1156, 1591, 735, 625, or 135, or a polypeptide sequence within the AtNAC6, WRKY17, AtNPR3, AtMYC1, AtMYB19, ERF058, CRF1, WRKY3, ZAT11, MYB111, SPATULA, or AtMYB50 clade (recombinant polynucleotides encoding AtNAC6, WRKY17, AtNPR3, AtMYC1, AtMYB19, ERF058, CRF1, WRKY3, ZAT11, MYB111, SPATULA, or AtMYB50 clade polypeptides are described in the following paragraphs (a)-(c), and exemplary polypeptides within the clade are described in the following paragraphs (d)-(f) and are shown in FIGS. 1, 2A-2I, 5, 6A-6J, 7, 8A-8I, 10, 11A-11H, 13, 14A-14L, 15, 16A-16J, 17, 18A-18L, 20, 21A-21O, 23, 24A-24O, 28, 29A-29I, 32, 33A-33H, 35, and 36A-36E).

The recombinant polynucleotide that encodes an AtNAC6, WRKY17, AtNPR3, AtMYC1, AtMYB19, ERF058, CRF1, WRKY3, ZAT11, MYB111, SPATULA, or AtMYB50 clade polypeptide may include:

(a) nucleic acid sequences that are at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% identical to SEQ ID NO 1368, 1370, 1372, 1374, 1376, 1378, 1380, 1382, 1384, 1386, 1388, 1390, 1392, 1394, 1396, 1398, 1400, 1402, 1404, 1406, 1408, 1410, 1412, 1414, 1416, 1418, 1420, 1422, 1424, 1426, 1428, 1430, 1432; or 1506, 1508, 1510, 1512, 1514, 1516, 1518, 1520, 1522, 1524, 1526, 1528, 1530; or 863, 865, 867, 869, 871, 873, 875, 877, 879, 881, 883, 885, 887, 889, 891, 893, 895, 897, 899, 901, 903, 905, 907, 909, 911, 913, 915, 917, 919, 921; or 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071; or 1, 3, 5, 7, 9, 11, 13, 15, 17, 19, 21, 23, 25, 27, 29, 31, 33; or 489, 491, 493, 495, 497, 499, 501, 503, 505, 507, 509, 511, 513, 515, 517, 519, 521, 523, 525, 527, 529, 531, 533, 535, 537, 539, 541, 543, 545, 547; or 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394; or 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 122;5 or 1590, 1592, 1594, 1596, 1598, 1600, 1602, 1604, 1606, 1608, 1610, 1612, 1614, 1616; or 734, 736, 738, 740, 742, 744, 746, 748, 750, 752, 754, 756, 758, 760, 762, 764, 766, 768, 770, 772, 774, 776, 778, 780, 782; or 624, 626, 628, 630, 632, 634, 636, 638, 640, 642, 644, 646, 648, 650, 652, 654, 656, 658, 660, 662, 664; or 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208; and/or (b) nucleic acid sequences that encode polypeptide sequences that are at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% identical in their amino acid sequences to the entire length of any of SEQ ID NO: 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433; or 1507, 1509, 1511, 1513, 1515, 1517, 1519, 1521, 1523, 1525, 1527, 1529, 1531; or 864, 866, 868, 870, 872, 874, 876, 878, 880, 882, 884, 886, 888, 890, 892, 894, 896, 898, 900, 902, 904, 906, 908, 910, 912, 914, 916, 918, 920, 922; or 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072; or: 2, 4, 6, 8, 10, 12, 14, 16, 18, 20, 22, 24, 26, 28, 30, 32, 34; or 490, 492, 494, 496, 498, 500, 502, 504, 506, 508, 510, 512, 514, 516, 518, 520, 522, 524, 526, 528, 530, 532, 534, 536, 538, 540, 542, 544, 546, 548; or 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395; or 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226; or 1591, 1593, 1595, 1597, 1599, 1601, 1603, 1605, 1607, 1609, 1611, 1613, 1615, 1617; or 735, 737, 739, 741, 743, 745, 747, 749, 751, 753, 755, 757, 759, 761, 763, 765, 767, 769, 771, 773, 775, 777, 779, 781, 783; or 625, 627, 629, 631, 633, 635, 637, 639, 641, 643, 645, 647, 649, 651, 653, 655, 657, 659, 661, 663, 665; or 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209; or (c) nucleic acid sequences that hybridize under stringent conditions (e.g., hybridization followed by one, two, or more wash steps of 6×SSC and 65° C. for ten to thirty minutes per step) to any of SEQ ID NO: SEQ ID NO 1368, 1370, 1372, 1374, 1376, 1378, 1380, 1382, 1384, 1386, 1388, 1390, 1392, 1394, 1396, 1398, 1400, 1402, 1404, 1406, 1408, 1410, 1412, 1414, 1416, 1418, 1420, 1422, 1424, 1426, 1428, 1430, 1432; or 1506, 1508, 1510, 1512, 1514, 1516, 1518, 1520, 1522, 1524, 1526, 1528, 1530; or 863, 865, 867, 869, 871, 873, 875, 877, 879, 881, 883, 885, 887, 889, 891, 893, 895, 897, 899, 901, 903, 905, 907, 909, 911, 913, 915, 917, 919, 921; or 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071; or 1, 3, 5, 7, 9, 11, 13, 15, 17, 19, 21, 23, 25, 27, 29, 31, 33; or 489, 491, 493, 495, 497, 499, 501, 503, 505, 507, 509, 511, 513, 515, 517, 519, 521, 523, 525, 527, 529, 531, 533, 535, 537, 539, 541, 543, 545, 547; or 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394; or 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 122;5 or 1590, 1592, 1594, 1596, 1598, 1600, 1602, 1604, 1606, 1608, 1610, 1612, 1614, 1616; or 734, 736, 738, 740, 742, 744, 746, 748, 750, 752, 754, 756, 758, 760, 762, 764, 766, 768, 770, 772, 774, 776, 778, 780, 782; or 624, 626, 628, 630, 632, 634, 636, 638, 640, 642, 644, 646, 648, 650, 652, 654, 656, 658, 660, 662, 664; or 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, or 208.

The AtNAC6, WRKY17, AtNPR3, AtMYC1, AtMYB19, ERF058, CRF1, WRKY3, ZAT11, MYB111, SPATULA, or AtMYB50 clade polypeptides may include:

(d) polypeptide sequences encoded by the nucleic acid sequences of (a), (b) and/or (c); and/or (e) polypeptide sequences that have at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% amino acid identity to SEQ ID NO: 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433; or 1507, 1509, 1511, 1513, 1515, 1517, 1519, 1521, 1523, 1525, 1527, 1529, 1531; or 864, 866, 868, 870, 872, 874, 876, 878, 880, 882, 884, 886, 888, 890, 892, 894, 896, 898, 900, 902, 904, 906, 908, 910, 912, 914, 916, 918, 920, 922; or 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072; or: 2, 4, 6, 8, 10, 12, 14, 16, 18, 20, 22, 24, 26, 28, 30, 32, 34; or 490, 492, 494, 496, 498, 500, 502, 504, 506, 508, 510, 512, 514, 516, 518, 520, 522, 524, 526, 528, 530, 532, 534, 536, 538, 540, 542, 544, 546, 548; or 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395; or 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226; or 1591, 1593, 1595, 1597, 1599, 1601, 1603, 1605, 1607, 1609, 1611, 1613, 1615, 1617; or 735, 737, 739, 741, 743, 745, 747, 749, 751, 753, 755, 757, 759, 761, 763, 765, 767, 769, 771, 773, 775, 777, 779, 781, 783; or 625, 627, 629, 631, 633, 635, 637, 639, 641, 643, 645, 647, 649, 651, 653, 655, 657, 659, 661, 663, 665; or 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, or 209; and/or (f) polypeptide sequences that have at least 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% amino acid identity to the SEQ ID NO:1434 ('NAM domain') or SEQ ID NO: 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465 1466, or SEQ ID NO: 1507 ('Plant Zinc Cluster Domain') or SEQ ID NOs: 1532, 1533, 1534, 1535, 1536, 1537, 1538, 1539, 1540, 1541, 1542, 1543 1544, or SEQ ID NO:864 ('BTB domain') or any of SEQ ID NOs: 923-950, or SEQ ID NO: 1016 ('bHLH-MYC_N domain') or SEQ ID NO: 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127 1129, or SEQ ID NO: 2 ('Myb DNA binding domain 1') or SEQ ID NOs: 61-77 ('Myb Domain'), or SEQ ID NO: 1156 ('WRKY Domain 1') or SEQ ID NO: 1227, 1229, 1231, 1233, 1235, 1237, 1239, 1241, 1243, 1245, 1247, 1249, 1251, 1253, 1255, 1257, 1259, 1261, 1263, 1265, 1267, 1269, 1271, 1273, 1275, 1277, 1279, 1281, 1283, 1285, 1287, 1289, 1291, 1293, 1295 1297; or SEQ ID NO: 1591 ('Z-C2H2-1') or SEQ ID NO: 1618, 1619, 1620, 1621, 1622, 1623, 1624, 1625, 1626, 1627, 1628, 1629, 1630 1631, or ('AP2 domain') 549, 550, 551, 552, 553, 554, 555, 556, 557, 558, 559, 560, 561, 562, 563, 564, 565, 566, 567, 568, 569, 570, 571, 572, 573, 574, 575, 576, 577 578, or SEQ ID NO: 307 ('AP2 domain') or any of SEQ ID NO: 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439 440, or SEQ ID NO: 625 ('HLH domain') or SEQ ID NO: 666, 667, 668, 669, 670, 671, 672, 673, 674, 675, 676, 677, 678, 679, 680, 681, 682, 683, 684, 685 686; and/or, or SEQ ID NO: 735 ('SANT domain 1') or SEQ ID NO: 784, 786, 788, 790, 792, 794, 796, 798, 800, 802, 804, 806, 808, 810, 812, 814, 816, 818, 820, 822, 824, 826, 828, 830 832, or SEQ ID NO: 135 ('Myb DNA binding domain 1') or SEQ ID NOs: 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282 284; or to SEQ ID NO: 1507 ('WRKY DNA-binding Domain') or SEQ ID NOs: 1545, 1546, 1547, 1548, 1549, 1550, 1551, 1552, 1553, 1554, 1555, 1556 1557 or SEQ ID NO:864 ('ANK domain') or any of SEQ ID NOs: 951 to 980 or SEQ ID NO: 1016 ('HLH domain 2') or SEQ ID NO: 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130 or SEQ ID NO: 2 ('Myb DNA binding domain 2') or SEQ ID NOs: 95-111 or SEQ ID NO: 1156 ('WRKY Domain 2') or SEQ ID NO: 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, 1286, 1288, 1290, 1292, 1294, 1296 1298 or SEQ ID NO: 1591 ('Z-C2H2-2 domain') or SEQ ID NO: 1632, 1633, 1634, 1635, 1636, 1637, 1638, 1639, 1640, 1641, 1642, 1643, 1644 1645 or SEQ ID NO: 735 ('SANT domain 2') or SEQ ID NO: 785, 787, 789, 791, 793, 795, 797, 799, 801, 803, 805, 807, 809, 811, 813, 815, 817, 819, 821, 823, 825, 827, 829, 831 833 or SEQ ID NO: 135 ('Myb DNA binding domain 2') or SEQ ID NOs: 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285; and/or (g) polypeptide sequences that comprise a subsequence that is at least 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% identical to a consensus sequence of SEQ ID NO: 1467, 1468, 1469 of the AtNAC6 clade, SEQ ID NO: 1558, 1559, 1560, 1561 of the WRKY17 clade, SEQ ID NO: 981, 982, 983, 984, 985, 986 of the AtNPR3 clade, SEQ ID NO: 1153, 1154 of the AtMYC1 clade, SEQ ID NO: 129, 130, or 133 of the AtMYB19 clade, SEQ ID NO: 579, 580, 581 of the ERF058 clade, SEQ ID NO: 441, 442 of the CRF1 clade, SEQ ID NO: 1299, 1300 of the WRKY3 clade, SEQ ID NO: 1646, 1647, 1648, of the ZAT11 clade, SEQ ID NO: 834, 835, 836 of the MYB111 clade, SEQ ID NO: 687 of the SPATULA clade, or SEQ ID NO: 302, 303, 304, 305 of the AtMYB50 clade, or that comprises a consensus sequence of SEQ ID NO: 1467, 1468, 1469 of the AtNAC6 clade, SEQ ID NO: 1558, 1559, 1560, 1561 of the WRKY17 clade, SEQ ID NO: 981, 982, 983, 984, 985, 986 of the AtNPR3 clade, SEQ ID NO: 1153, 1154 of the AtMYC1 clade, SEQ ID NO: 129, 130, or 133 of the AtMYB19 clade, SEQ ID NO: 579, 580, 581 of the ERF058 clade, SEQ ID NO: 441, 442 of the CRF1 clade, SEQ ID NO: 1299, 1300 of the WRKY3 clade, SEQ ID NO: 1646, 1647, 1648, of the ZAT11 clade, SEQ ID NO: 834, 835, 836 of the MYB111 clade, SEQ ID NO: 687 of the SPATULA clade, or SEQ ID NO: 302, 303, 304, 305 of the AtMYB50 clade.

BRIEF DESCRIPTION OF THE SEQUENCE LISTING AND DRAWINGS

The Sequence Listing provides exemplary polynucleotide and polypeptide sequences of the instant description. The traits associated with the use of the sequences are included in the Examples.

Incorporation of the Sequence Listing.

The Sequence Listing provides exemplary polynucleotide and polypeptide sequences. The copy of the Sequence Listing, being submitted electronically with this patent application, provided under 37 CFR §1.821-1.825, is a read-only memory computer-readable file in ASCII text format. The Sequence Listing is named "MBI-0215PCT-.txt", the electronic file of the Sequence Listing was created on Jul. 31, 2013, and is (3,383,248 bytes in size (3.22 megabytes in size as measured in MS-WINDOWS). The Sequence Listing is herein incorporated by reference in its entirety.

In FIG. 1, a phylogenetic tree of the AtMYB19 (also referred to as AT5G52260.1 or G1309) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. The AtMYB19 clade members appear in the large box with the solid line boundary. AtMYB19 appears in the oval. An ancestral sequence of AtMYB19 and closely-related sequences is represented by the node of the tree indicated by the arrow "A" in FIG. 1. AtMYB19 clade members are considered those proteins that descended from ancestral sequence "A", including the exemplary sequences shown in this figure that are bounded by LOC_Os04g45020.1 and Solyc03g025870.2.1 (indicated by the box around these sequences). A related clade is represented by the node indicated by arrow "B".

FIGS. 2A-2I show an alignment of the AtMYB19 (AT5G52260.1) clade and related proteins which appear in the boxes with the solid line boundaries. The alignment was generated with MUSCLE v3.8.31 (Edgar (2004) *Nucleic Acids Res.* 32:1792-1797) with default parameters. SEQ ID NOs: appear in parentheses after each Gene Identifier (GID). The conserved first and second Myb DNA binding domains appear in boxes with the dashed line boundaries. The conserved residues within the clade are shown in the last rows of FIG. 2B-2D and are presented as SEQ ID NOs: 129 (underlined), 130 (double underlined) and 130. SEQ ID NOs: 129 and 130 share the triple underlined Glu residue in FIG. 2C.

Figure 3:
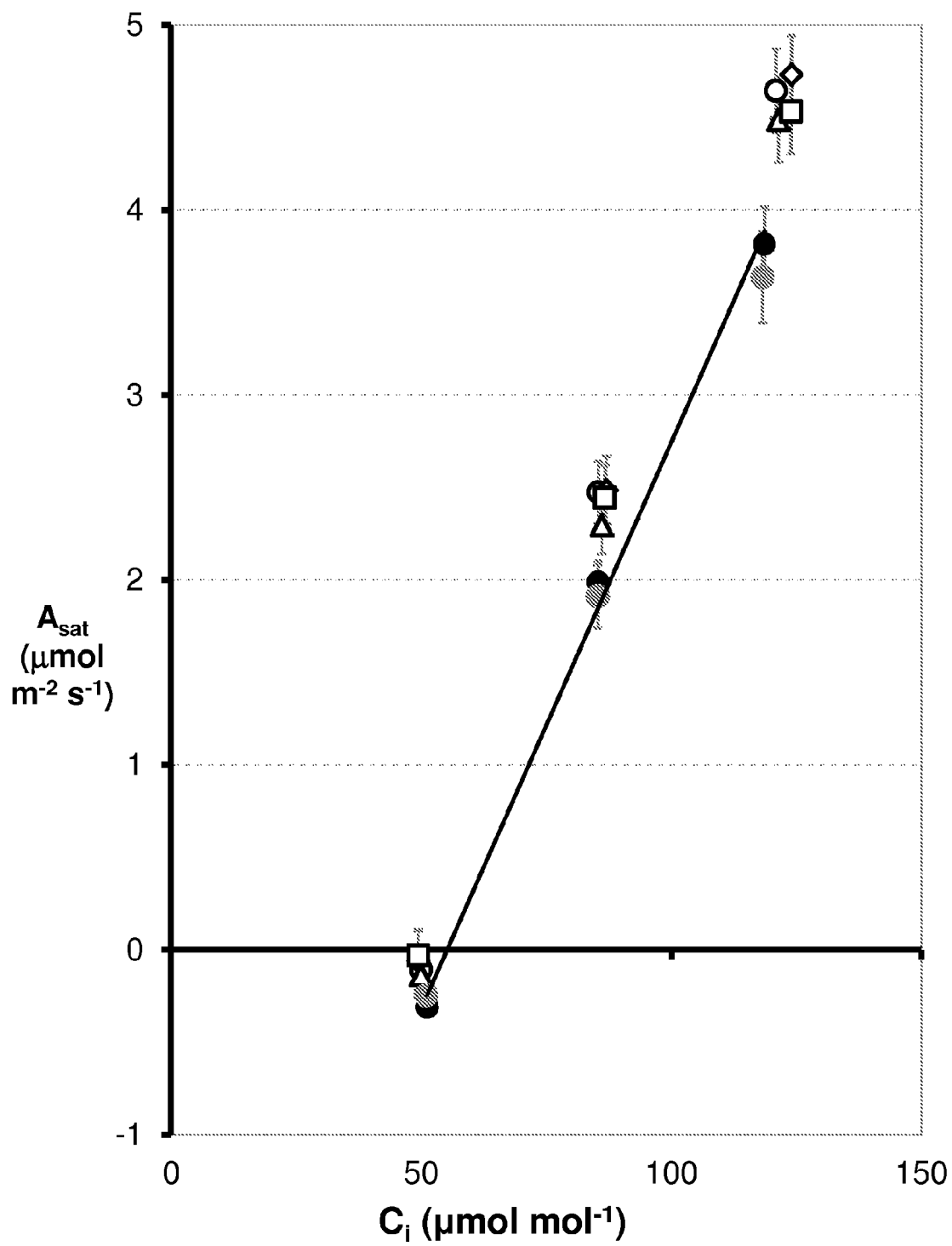

FIG. 3 presents a plot of photosynthetic capacity at growth temperature, showing increased light saturated photosynthesis ($A_{sat}$) over a range of leaf, sub-stomatal $CO_2$ concentration ($C_i$), in five AtMYB19 overexpression lines, compared to a control line. Data were collected over a range of $C_i$ over which the activity of Rubisco is known to limit $A_{sat}$. The solid line shown is a regression fitted to the data for the control line only. All data are the means±1 standard error for data collected on at least nine replicate plants for each line.

Figure 4:
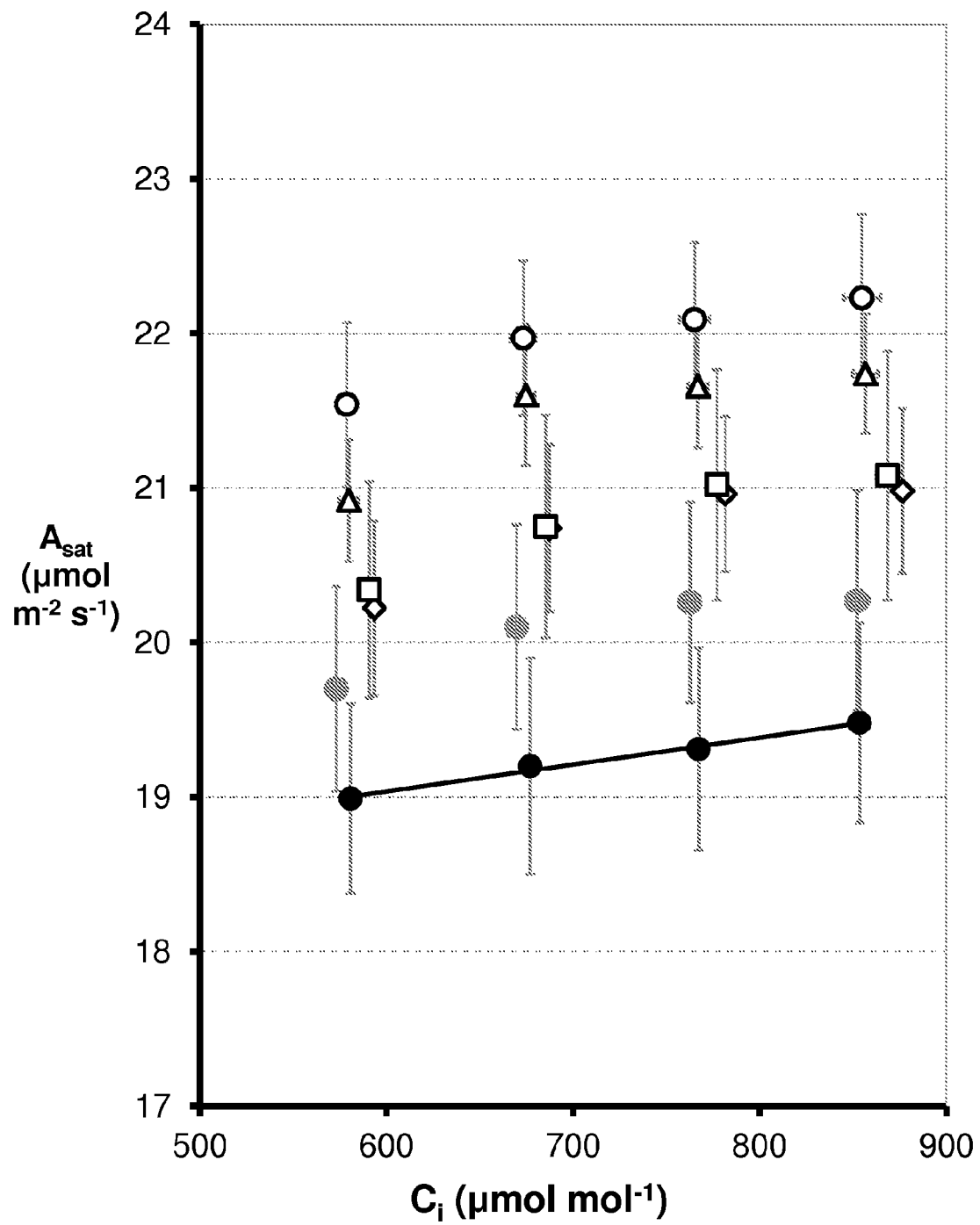

FIG. 4 presents a plot of photosynthetic capacity at growth temperature showing increased $A_{sat}$ over a range of leaf, sub-stomatal $C_i$ in five AtMYB19 overexpression lines, compared to a control line. Data were collected over a range of $C_i$ over which the capacity to regenerate RuBP is known to limit $A_{sat}$. The solid line shown is a regression fitted to the data for the control line only. All data are the means±1 standard error for data collected on at least nine replicate plants for each line.

Legend for FIG. 3 and FIG. 4:
● control
○ AtMYB19-Line 2
◇ AtMYB19-Line 3
Δ AtMYB19-Line 6
□ AtMYB19-Line 7
● AtMYB19-Line 8

Figure 5:
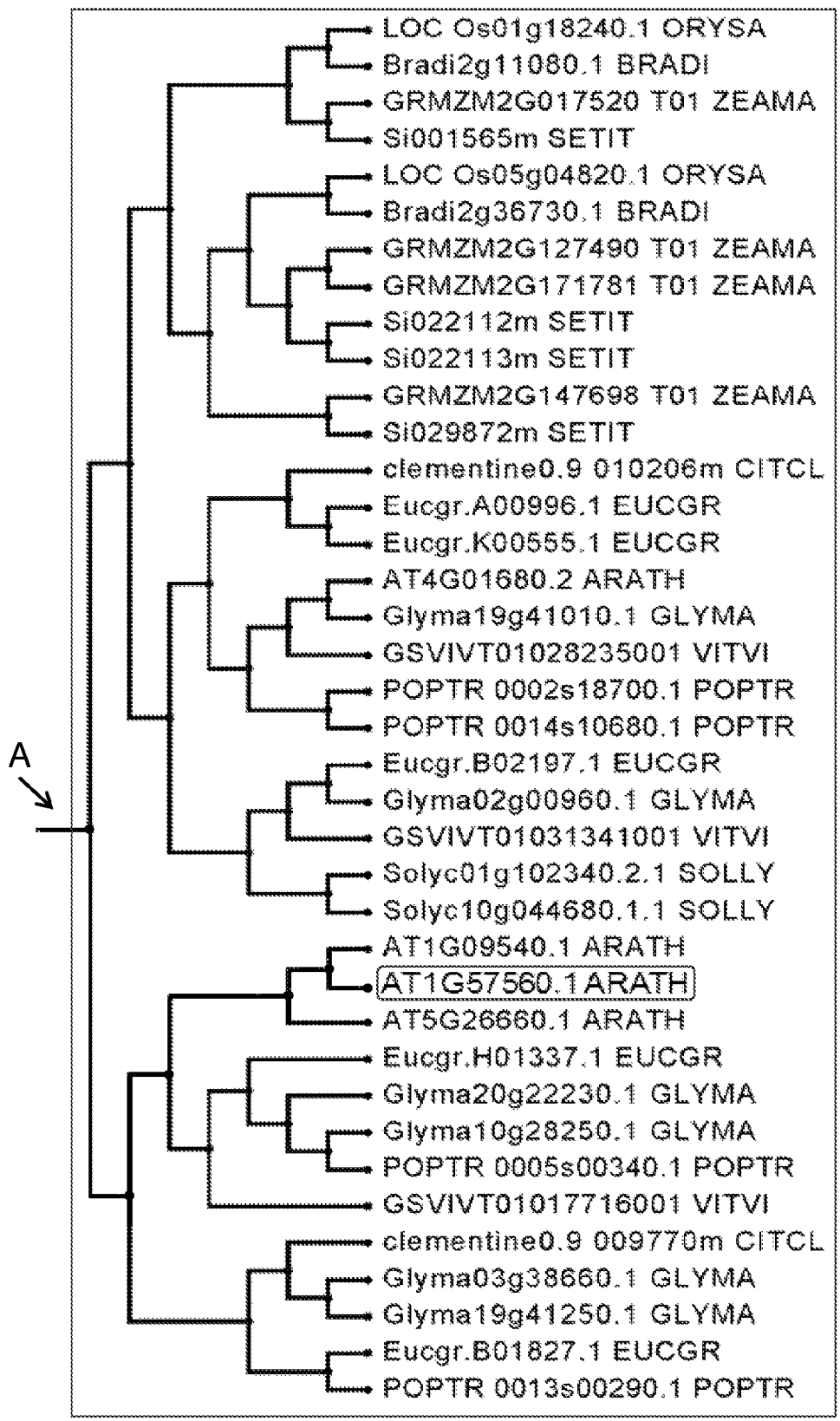

In FIG. 5, a phylogenetic tree of the AtMYB50 (also referred to as AT1G57560.1 or G1319) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. The AtMYB50 clade members appear in the large box with the solid line boundary. AtMYB50 (AT1G57560.1) appears in the rounded rectangle. An ancestral sequence of AtMYB50 and closely-related sequences is represented by the node of the tree indicated by the arrow "A" in FIG. 5. AtMYB50 clade members are considered those proteins that descended from ancestral sequence "A", including the exemplary sequences shown in this figure that are bounded by LOC_Os01g18240.1 and POPTR_0013 s00290.1 (indicated by the box around these sequences).

FIGS. 6A-6J show an alignment of AtMYB50 and representative clade-related proteins. The AtMYB50 clade sequences are identified within the bracket along the left-hand side of the sequences. The alignment was generated with MUSCLE v3.8.31 with default parameters. SEQ ID NOs: appear in parentheses after each Gene Identifier (GID). The conserved first and second Myb DNA binding domains appear in boxes with the dashed line boundaries in FIG. 6A-6C. A clade consensus sequence (SEQ ID NO: 302) comprising both of the conserved residues is shown in the last row in FIG. 6A-6C.

Figure 7:
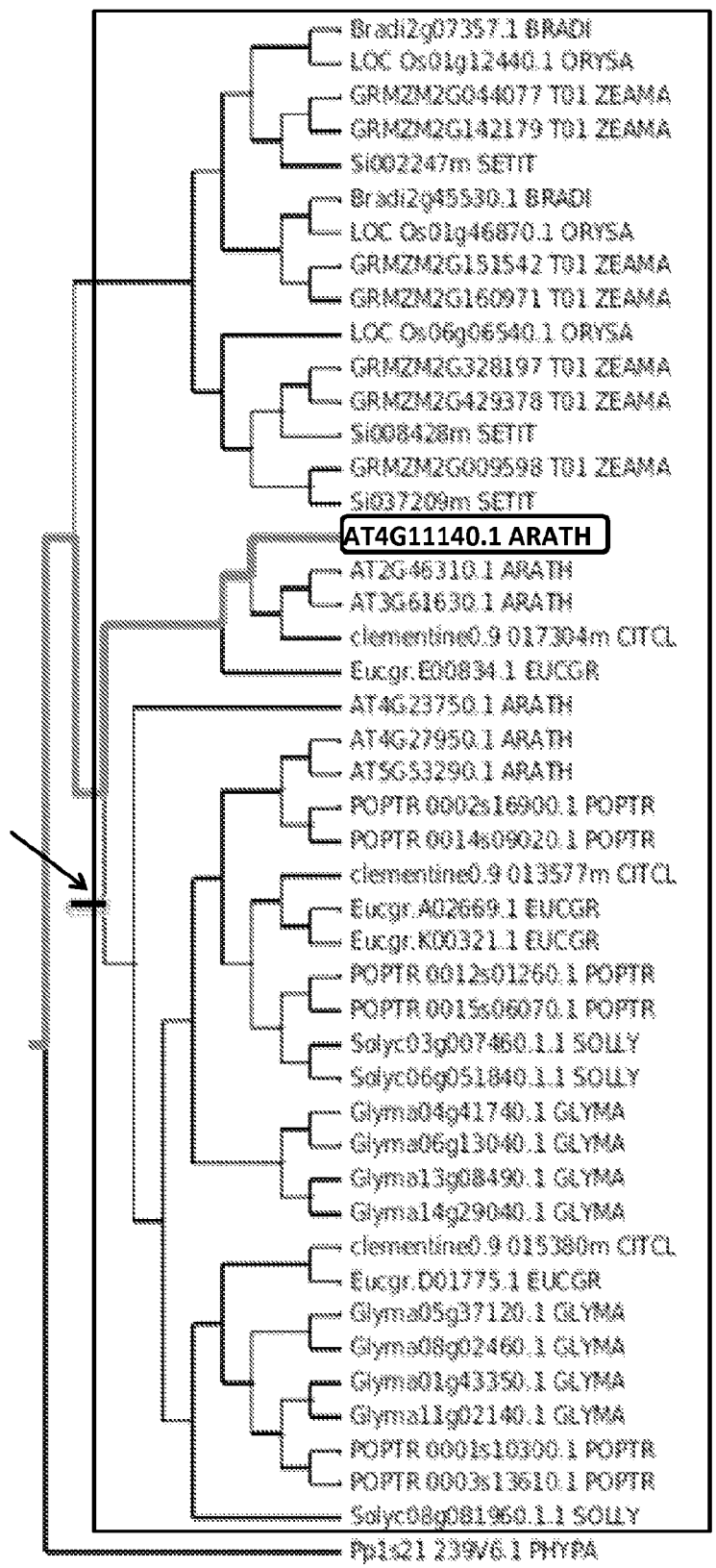

In FIG. 7, a phylogenetic tree of CRF1 or AT4G11140.1 (also referred to as NP_192852 or G1421) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. The CRF1 clade members appear in the large box. CRF1 (AT4G11140.1) appears in the rounded rectangle. An ancestral sequence of CRF1 and closely-related sequences is represented by the node of the tree indicated by the arrow "A" in FIG. 7. CRF1 clade members are considered those proteins that descended from ancestral sequence "A", including the exemplary sequences shown in this figure that are bounded by Bradi2g07357.1 and Solyc08g081960.1.1 (indicated by the box around these sequences).

Figure 8G:
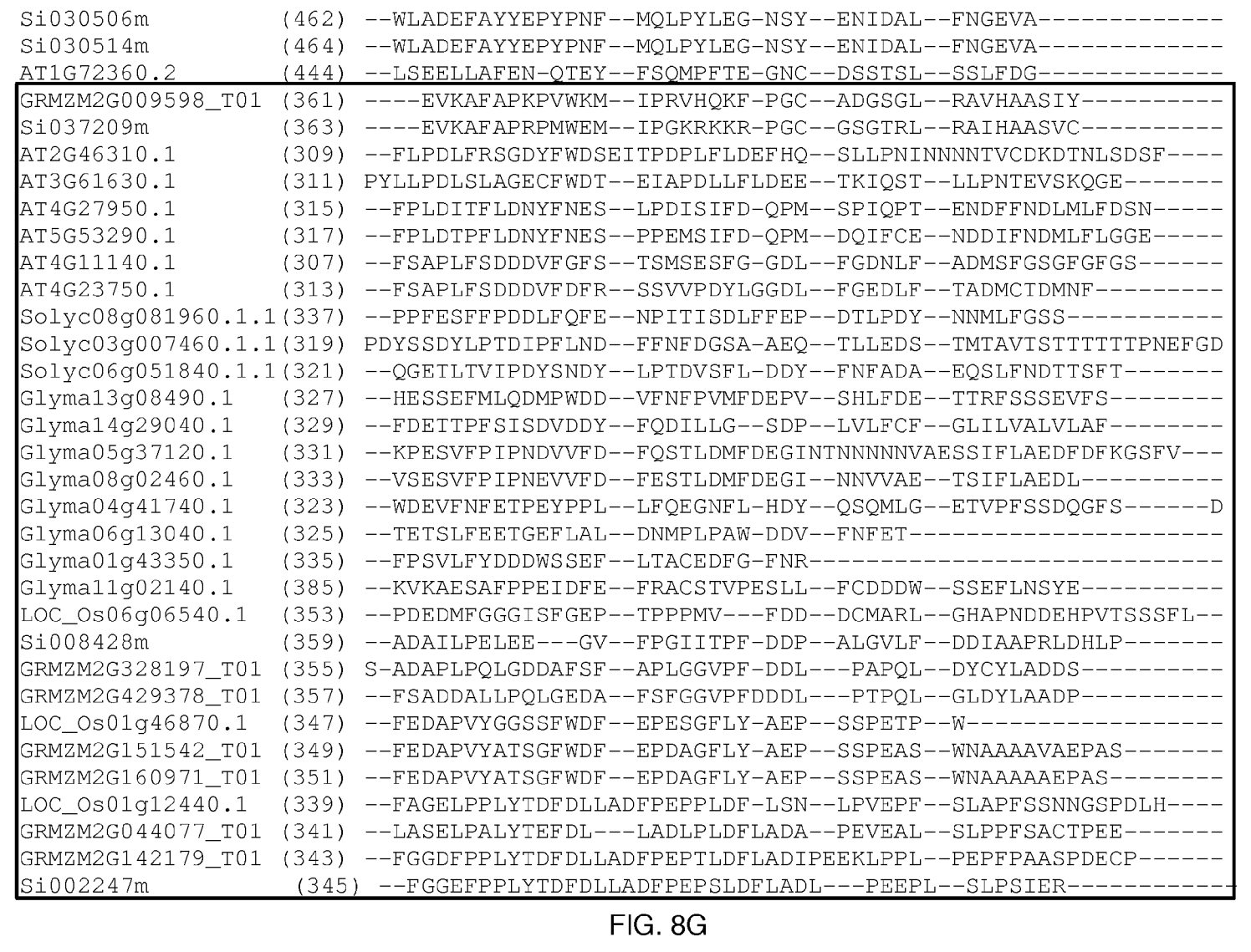

FIGS. 8A-8I show an alignment of CRF1 and representative clade-related proteins. The CRF1 clade sequences are identified within the large box in FIG. 8A-8I. The alignment was generated with MUSCLE v3.8.31 with default parameters. SEQ ID NOs: appear in parentheses after each Gene Identifier (GID). The conserved AP2 domains appear above the consensus sequence (SEQ ID NO: 441) in FIG. 8C-8D. A small clade consensus sequence (SEQ ID NO: 442) comprising conserved residues is also shown in the last row in FIG. 8A-8B.

Figure 9:
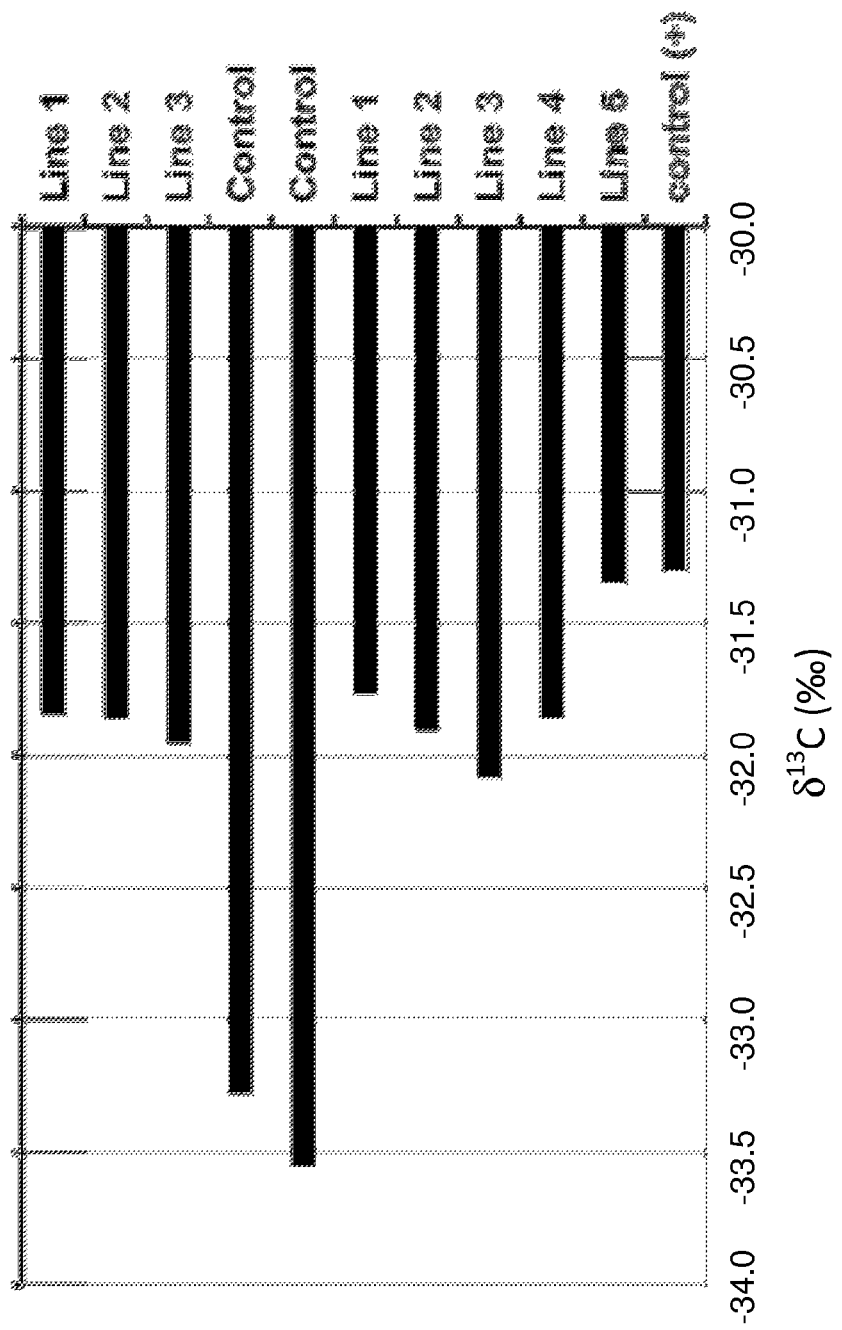

FIG. 9 shows the $\delta^{13}C$ values for dried, bulked rosette tissue from five independent CRF1 transgenic events, an empty vector control line (control) and a transgenic line know to increased rosette $\delta^{13}C$ (control+). Data were collected over two screening runs.

Figure 10:
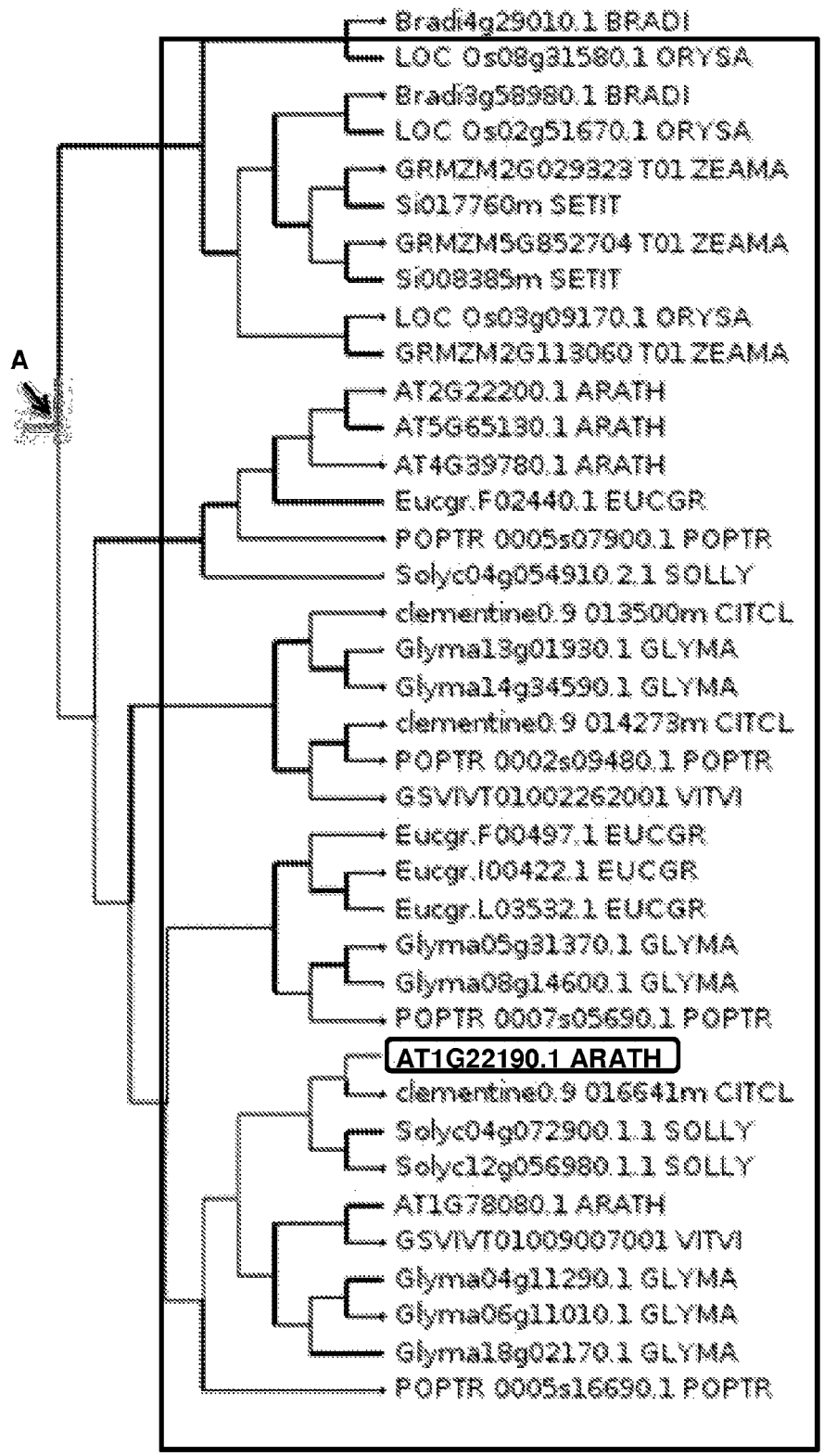

In FIG. 10, a phylogenetic tree of ERF058 or AT1G22190.1 (also referred to as ERF58 or G974) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. The ERF058 clade members appear in the large box with the solid line boundary. ERF058 (AT1G22190.1) appears in the rounded rectangle. An ancestral sequence of ERF058 and closely-related sequences is represented by the node of the tree indicated by the arrow "A" in FIG. 10. ERF058 clade members are considered those proteins that descended from ancestral sequence "A", including the exemplary sequences shown in this figure that are bounded by Bradi4g29010.1 and POPTR_0005 s16690.1 (indicated by the box around these sequences).

Figure 11A:
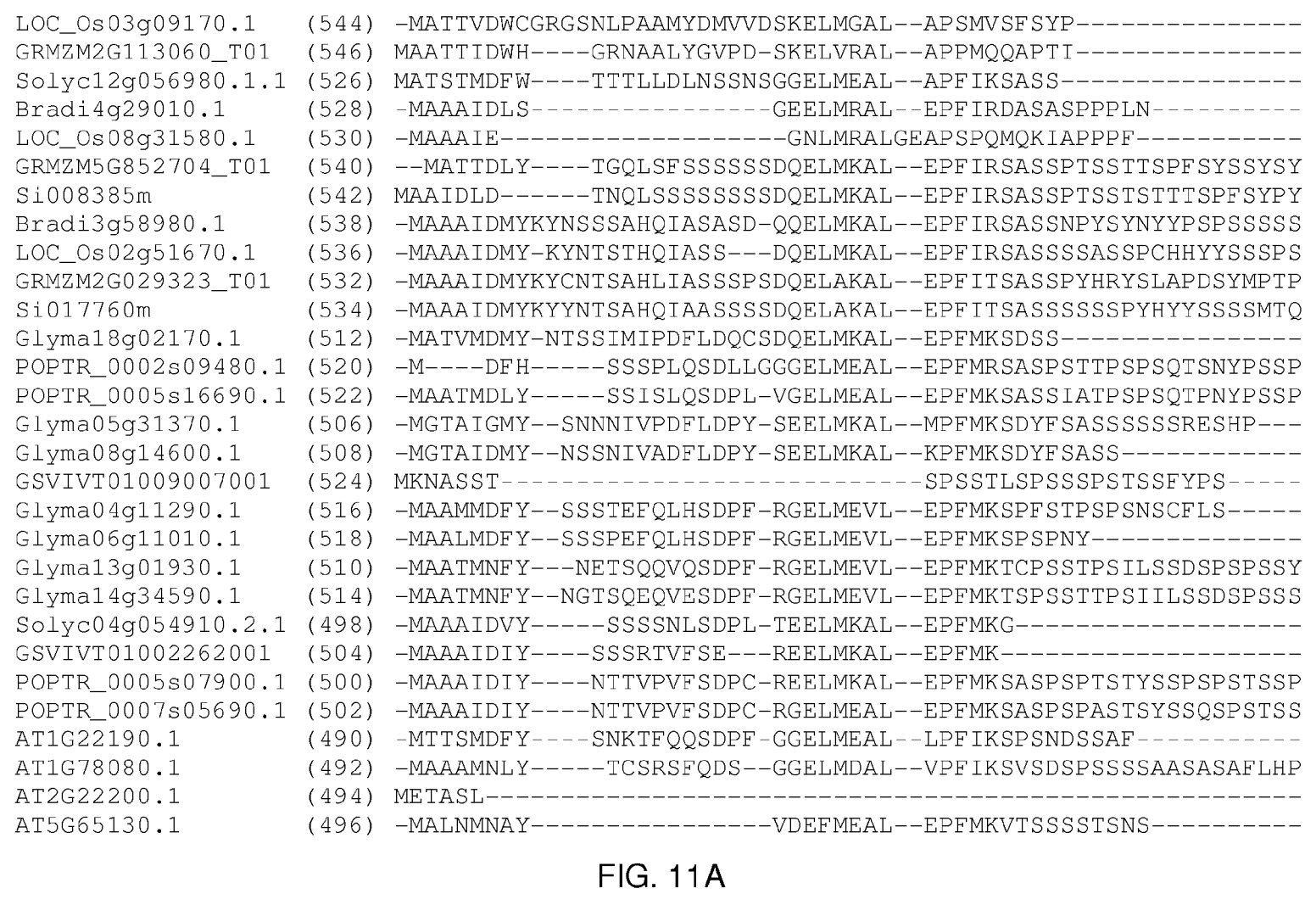

FIGS. 11A-11H show an alignment of ERF058 and representative clade-related proteins. The alignment was generated with MUSCLE v3.8.31 with default parameters. SEQ ID NOs: appear in parentheses after each Gene Identifier (GID). The amino acid residues of the conserved AP2 domains appear in boldface FIG. 11D-11E. *Clade* consensus sequences comprising conserved residues are shown in the last row in FIG. 11D-11H, in which a small letter 'x' refers to any amino acid, and a capital 'X' refers to conserved amino acids as identified in SEQ ID NO: 579 (shown in boldface), 580 or 581.

Figure 12:
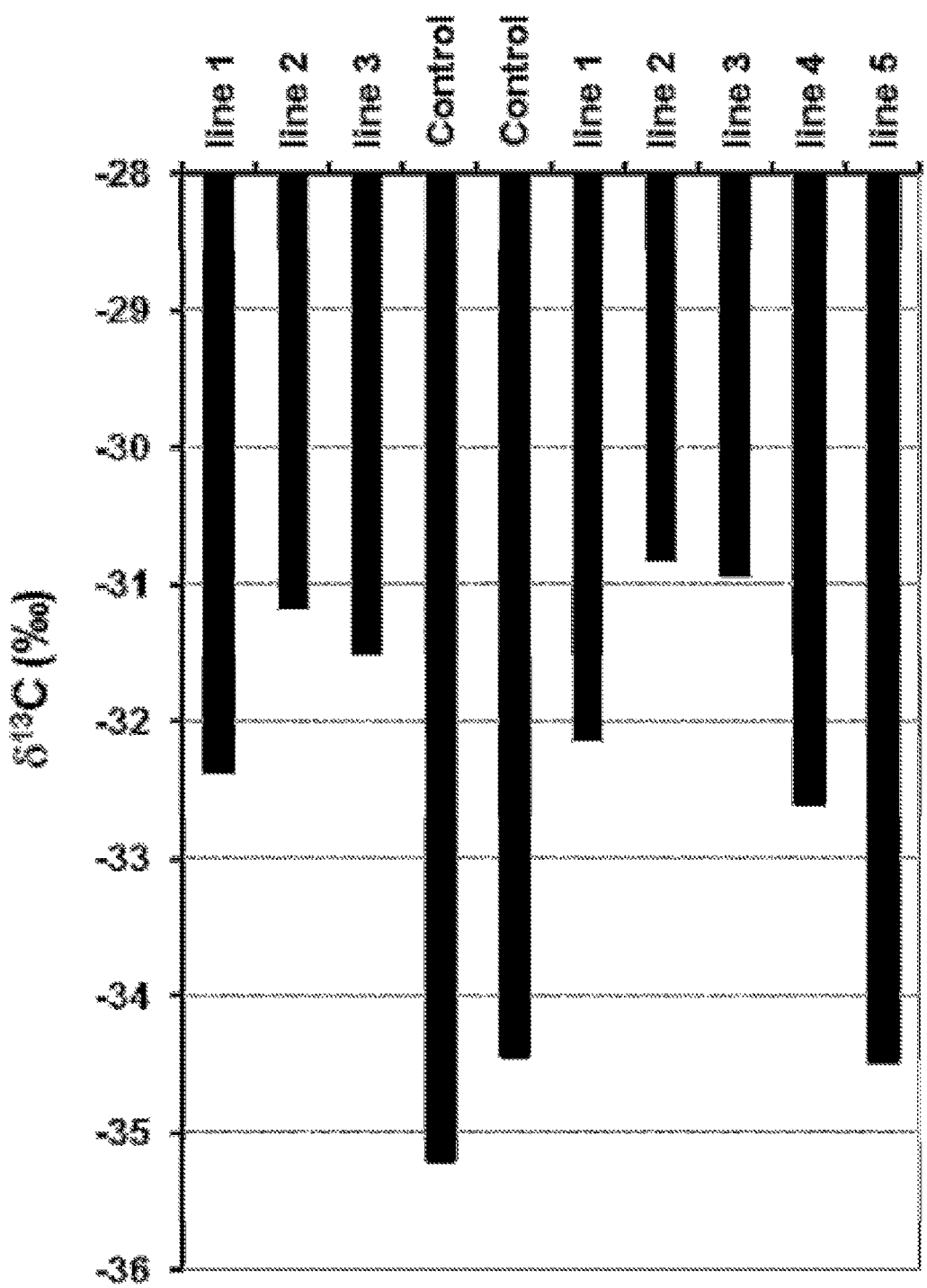

FIG. 12 shows how ectopic expression of ERF058 expression increases water-use efficiency. In these 35S::ERF058 lines derived from independent insertion events lines 1-3 left of control bars, and in a separate and subsequent analysis lines 1-5 to the right of the control bars), the ratio of $^{13}C$ to $^{12}C$ in the plant material was generally increased relative to control lines (that is, the ratio of $^{13}C$ to $^{12}C$ was generally less negative relative to a standard control plant). This directional change was consistent with decreased discrimination against $^{13}C$ during photosynthesis, the consequence of a lower concentration of $CO_2$ within the leaf and indicative of an increase in water-use efficiency integrated over the life of the plant's rosette.

Figure 13:
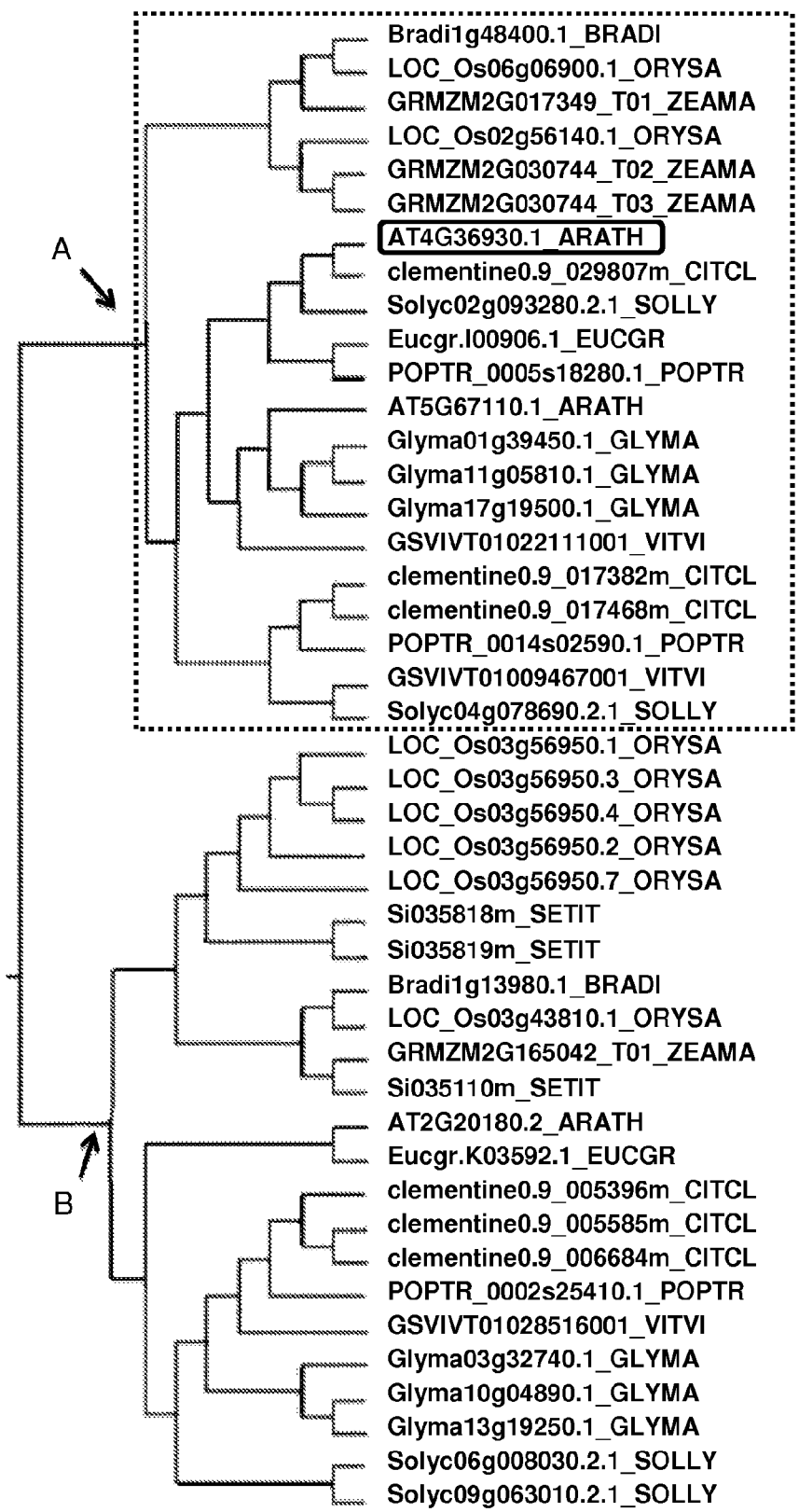

In FIG. 13, a phylogenetic tree of SPATULA or AT4G36930 (also referred to as G590) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. The SPATULA clade members appear in the large box with the dashed line boundary. The SPATULA (AT4G36930) polypeptide appears in the rounded rectangle. An ancestral sequence of SPATULA and closely-related sequences is represented by the node of the tree indicated by the arrow "A" in FIG. 13. SPATULA clade members are considered those proteins that descended from ancestral sequence "A", including the exemplary sequences shown in this figure that are bounded by Bradi1g48400.1_BRADI and Solyc04g078690.2.1_SOLLY (indicated by the box around these sequences with the dashed boundary). A related clade descends from a related ancestral sequence represented by the node indicated by arrow "B".

FIGS. 14A-14L show an alignment of SPATULA and representative clade-related proteins. The SPATULA clade sequences are identified within the bracket along the left-hand side of the sequences. SEQ ID NOs: appear in parentheses after each Gene Identifier (GID). The conserved HLH domains appear in the box with the dashed line boundaries in FIG. 14H. A clade consensus sequence (SEQ ID NO: 687) comprising conserved residues is shown in the last row in FIG. 14H-14I, in which $X^1$ is E or Q; $X^2$ is R or K; $X^3$ is G or S; $X^4$ is I, V, L, or M; $X^5$ is E or D; $X^6$ is Q or H; $X^7$ is Q or K; $X^8$ is I, V, L, M, or absent; and $X^9$ is S, T, A, or absent. In the sequences examined thus far, clade member polypeptides possess the three unique highlighted residues (position 17 is G or S and positions 32 and 33 are N and S, respectively). The alignment was generated with MUSCLE v3.8.31 with default parameters.

Figure 15:
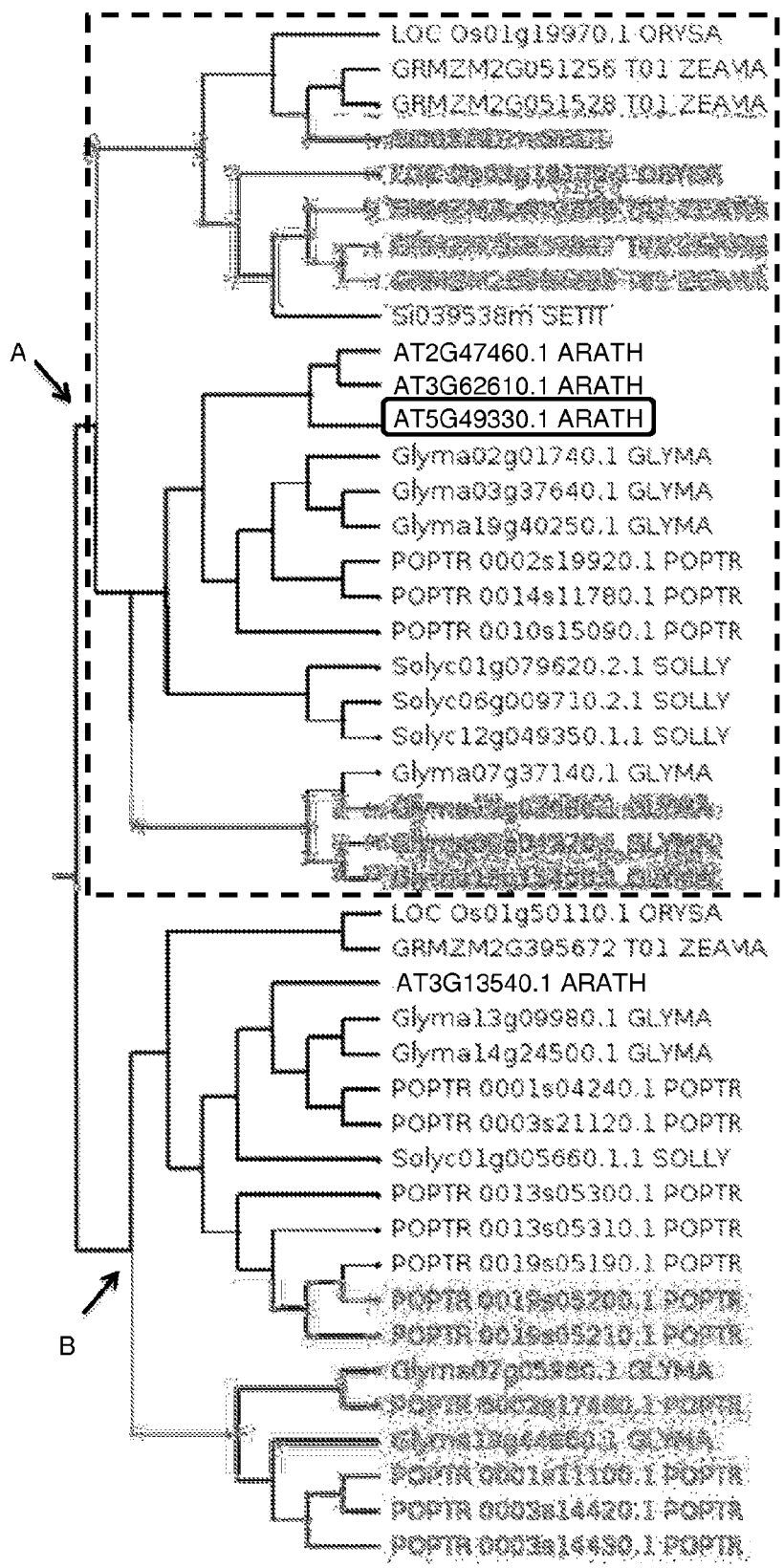

In FIG. 15, a phylogenetic tree of MYB111 (or AT5G49330 or G1640) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. The MYB111 clade members appear in the large box with the dashed line boundary. MYB111 (AT5G49330) appears in the rounded rectangle. An ancestral sequence of MYB111 and closely-related sequences is represented by the node of the tree indicated by the arrow "A" in FIG. 15. MYB111 clade members are considered those proteins that descended from ancestral sequence "A", including the exemplary sequences shown in this figure that are bounded by LOC_Os01g19970.1 and Glyma15g15400.1 (indicated by the dashed box around these sequences). A related clade is represented by the node indicated by arrow "B".

FIGS. 16A-16J show an alignment of MYB111 and representative clade-related proteins. The MYB111 clade sequences are identified within the bracket along the left-hand side of the sequences. The alignment was generated with MUSCLE v3.8.31 with default parameters. SEQ ID NOs: appear in parentheses after each Gene Identifier (GID). The conserved first and second SANT domains appear in boxes with the dashed line boundaries in FIG. 16A-16C. A clade consensus sequence (SEQ ID NO: 834) comprises conserved residues shown in the last row in FIG. 16A-16C.

Figure 17:
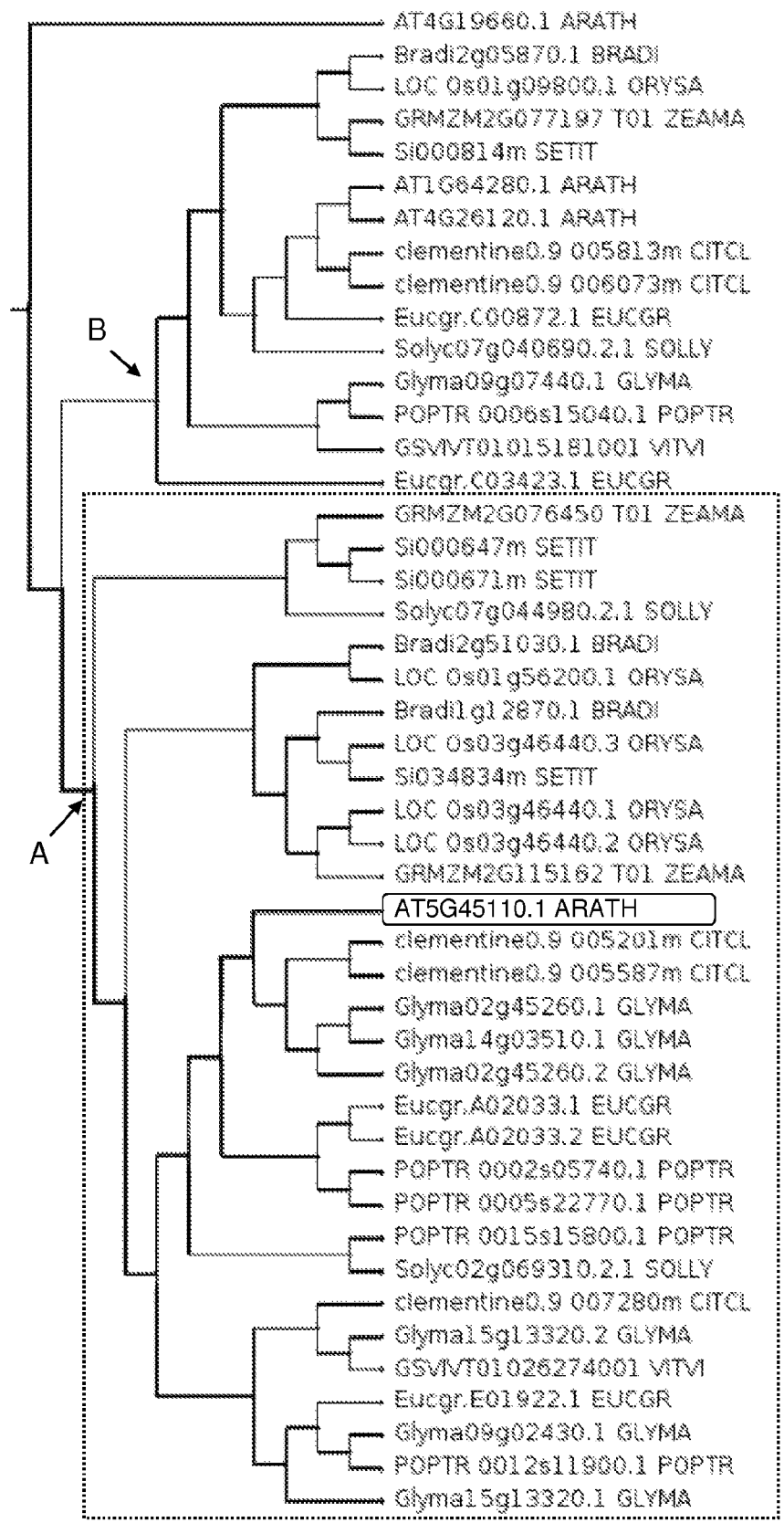

In FIG. 17, a phylogenetic tree of AtNPR3 or AT5G45110.1 (also referred to as G839) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. AtNPR3 clade members appear in the large box with the dashed line boundary. AtNPR3 (AT5G45110) appears in the rounded rectangle. An ancestral sequence of AtNPR3 and closely-related sequences is represented by the node of the tree indicated by the arrow "A" in FIG. 17. AtNPR3 clade members are considered those proteins that descended from ancestral sequence "A", including the exemplary sequences shown in this figure that are bounded by GRMZM2G076450_T01 and Glyma15g13320. A related clade is represented by the node indicated by arrow "B".

FIGS. 18A-18L show an alignment of AtNPR3 and representative clade-related proteins. The alignment was generated with MUSCLE v3.8.31 with default parameters. SEQ ID NOs: appear in parentheses after each Gene Identifier (GID). The conserved BTB and ANK domains appear in boxes in FIGS. 18B-18E and FIGS. 18F-18H, respectively. The BTB domain comprises consensus sequences SEQ ID NOs: 981 and 982). The ANK domain comprises consensus sequence SEQ ID NO: 983. Distinct small conserved or consensus motifs are shown in FIG. 18E between the BTB and DUF3420 domains (SEQ ID NO: 984), at the start of the DUF3420 domain in FIG. 18F (SEQ ID NO: 985), and within the NPR1-like C domain, in FIGS. 18H-18I (SEQ ID NO: 986).

Figure 19:
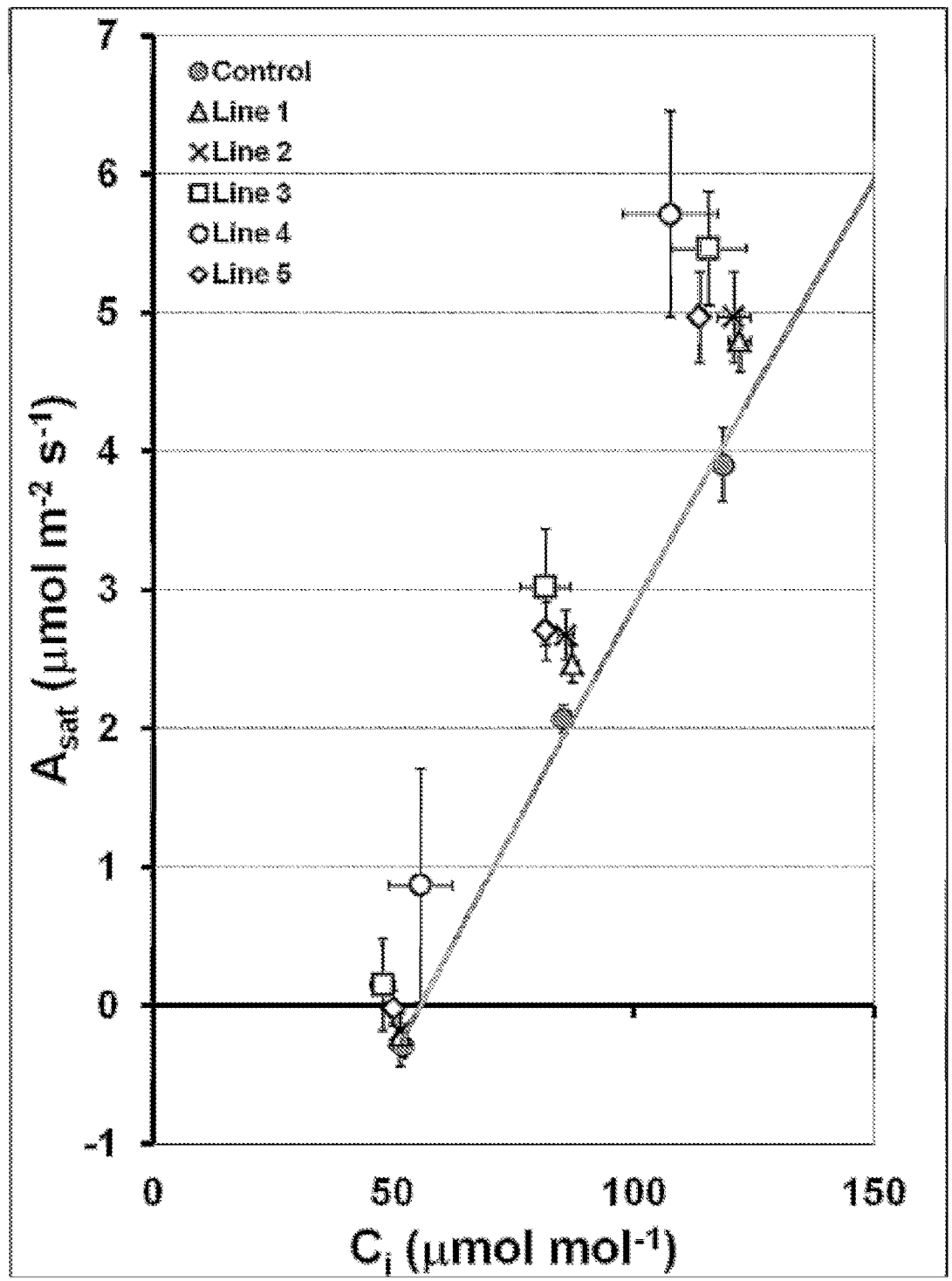

FIG. 19: Plot showing increased rate of light saturated photosynthesis ($A_{sat}$) over a range of leaf sub-stomatal $CO_2$ concentration ($C_i$) in 5 AtNPR3 overexpression lines (line 1-5), compared to a control line. The solid line shown is a regression fitted to the data for the control line only. All data are the means±1 standard error for data collected on at least six replicate plants for each line.

Figure 20:
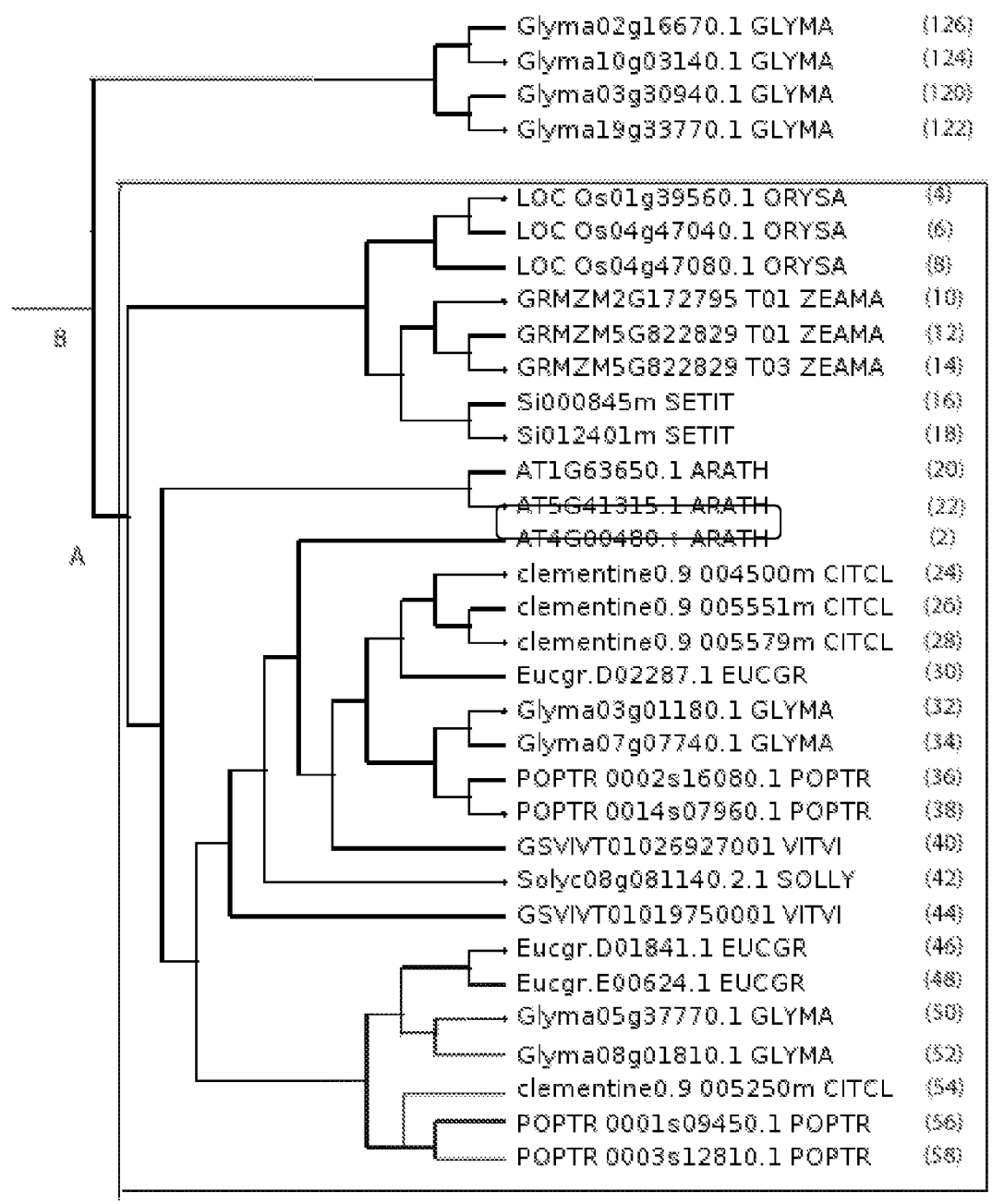

In FIG. 20, a phylogenetic tree of AtMYC1 or AT4G00480.1 (also referred to as G581) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. The AtMYC1 clade members appear in the large box with the solid line boundary. AtMYC1 (AT4G00480.1) appears in the rounded rectangle. An ancestral sequence of AtMYC1 and closely-related sequences is represented by the node of the tree indicated by the arrow "A" in FIG. 20. AtMYC1 clade members are considered those proteins that descended from ancestral sequence "A", including the exemplary sequences shown in this figure that are bounded by LOC_Os01g39650.1 and POPTR_0003 s0012810.1 (indicated by the box around these sequences). A related clade is represented by the node indicated by arrow "B".

Figure 21A:
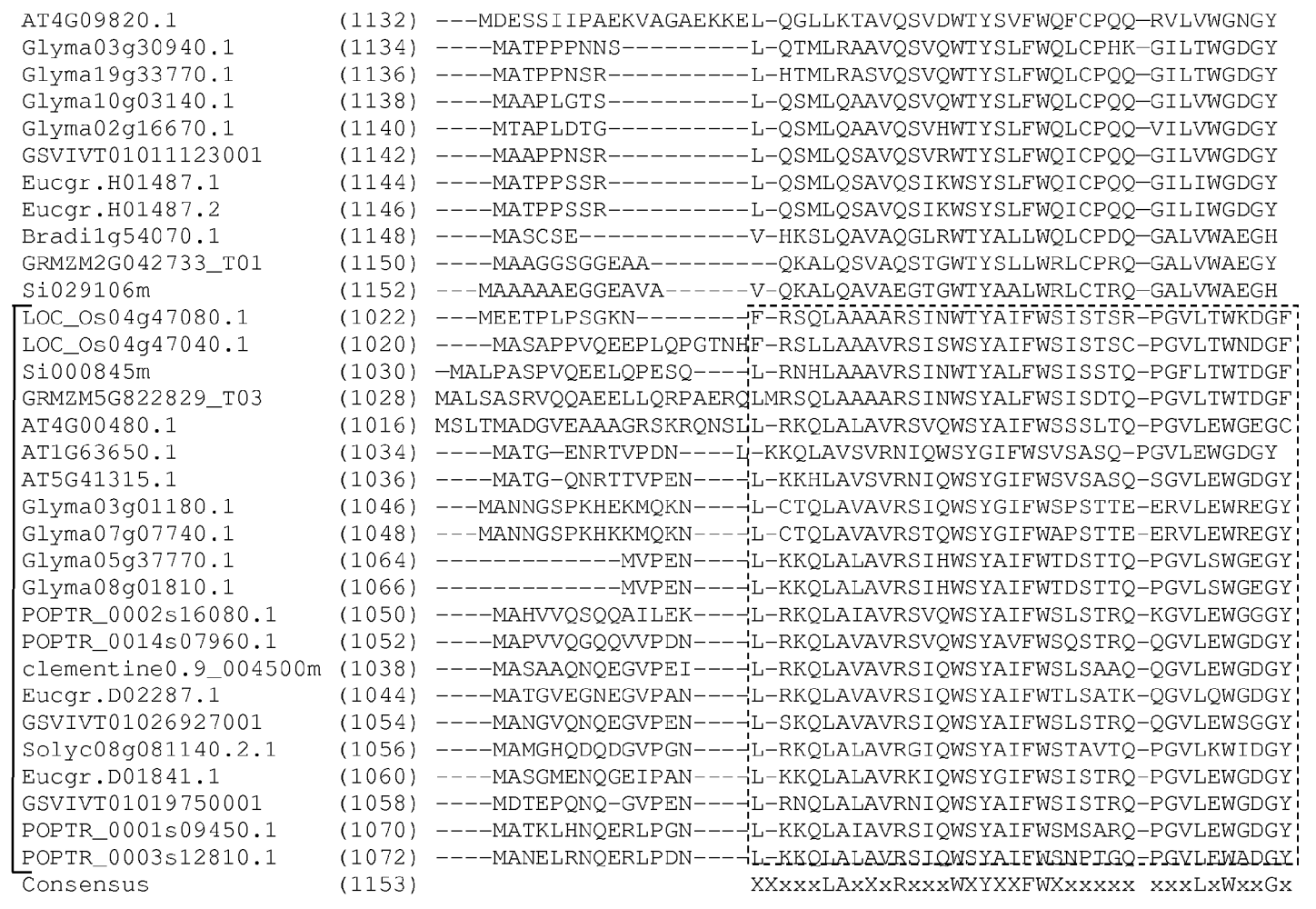
Figure 21D:
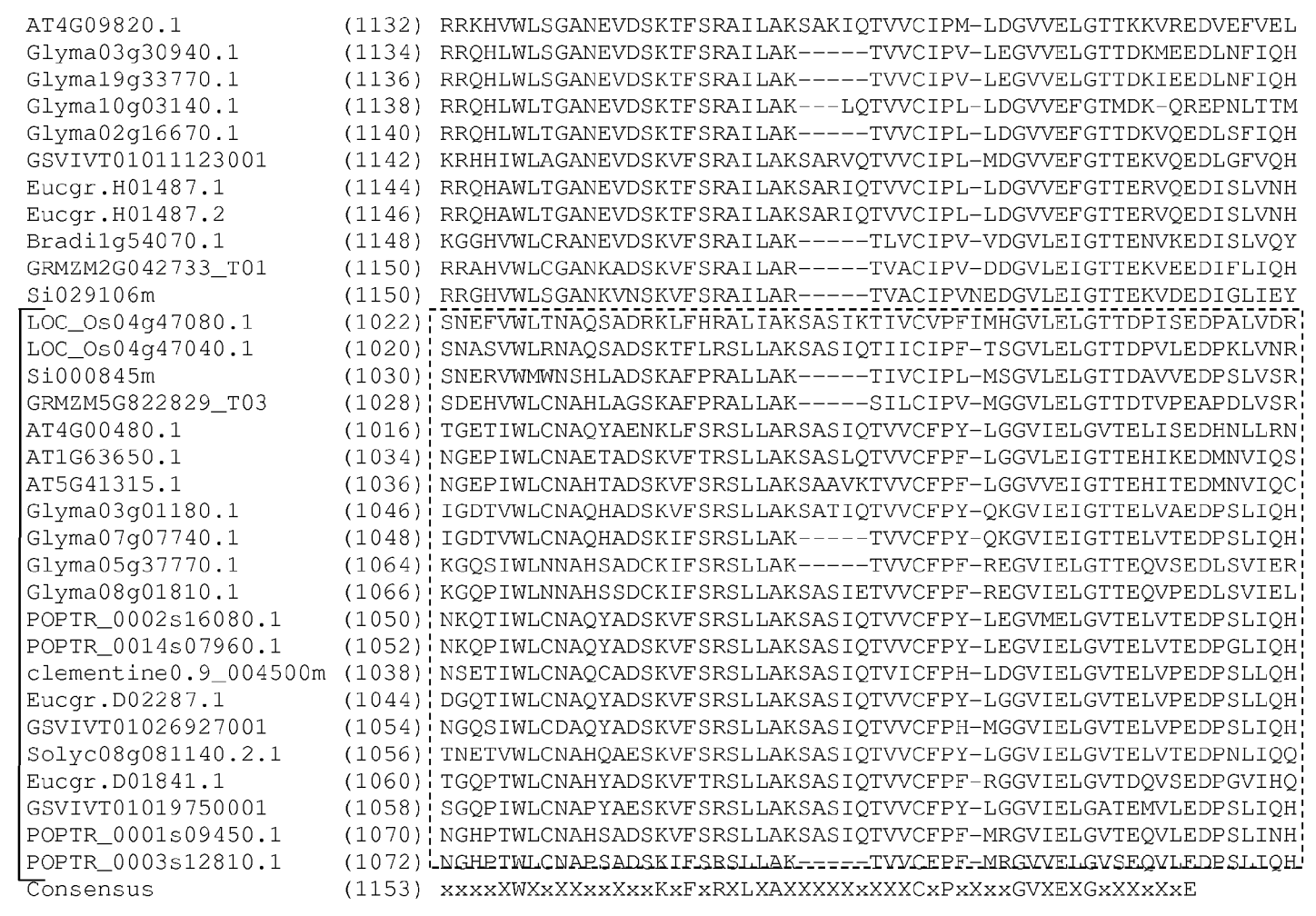

FIGS. 21A-21O show an alignment of AtMYC1 and representative clade-related proteins. The AtMYC1 clade sequences are identified within the bracket along the left-hand side of the sequences. The alignment was generated with MUSCLE v3.8.31 with default parameters. SEQ ID NOs: appear in parentheses after each Gene Identifier (GID). The conserved bHLH-MYC_N domain and HLH domain appear in boxes with the dashed line boundaries in FIG. 21A-21E and FIG. 21J-21K, respectively. Clade consensus sequences comprising conserved residues are shown in the last row in FIG. 21A-21D (SEQ ID NO: 1153) and FIG. 21K (SEQ ID NO: 1154).

Figure 22:
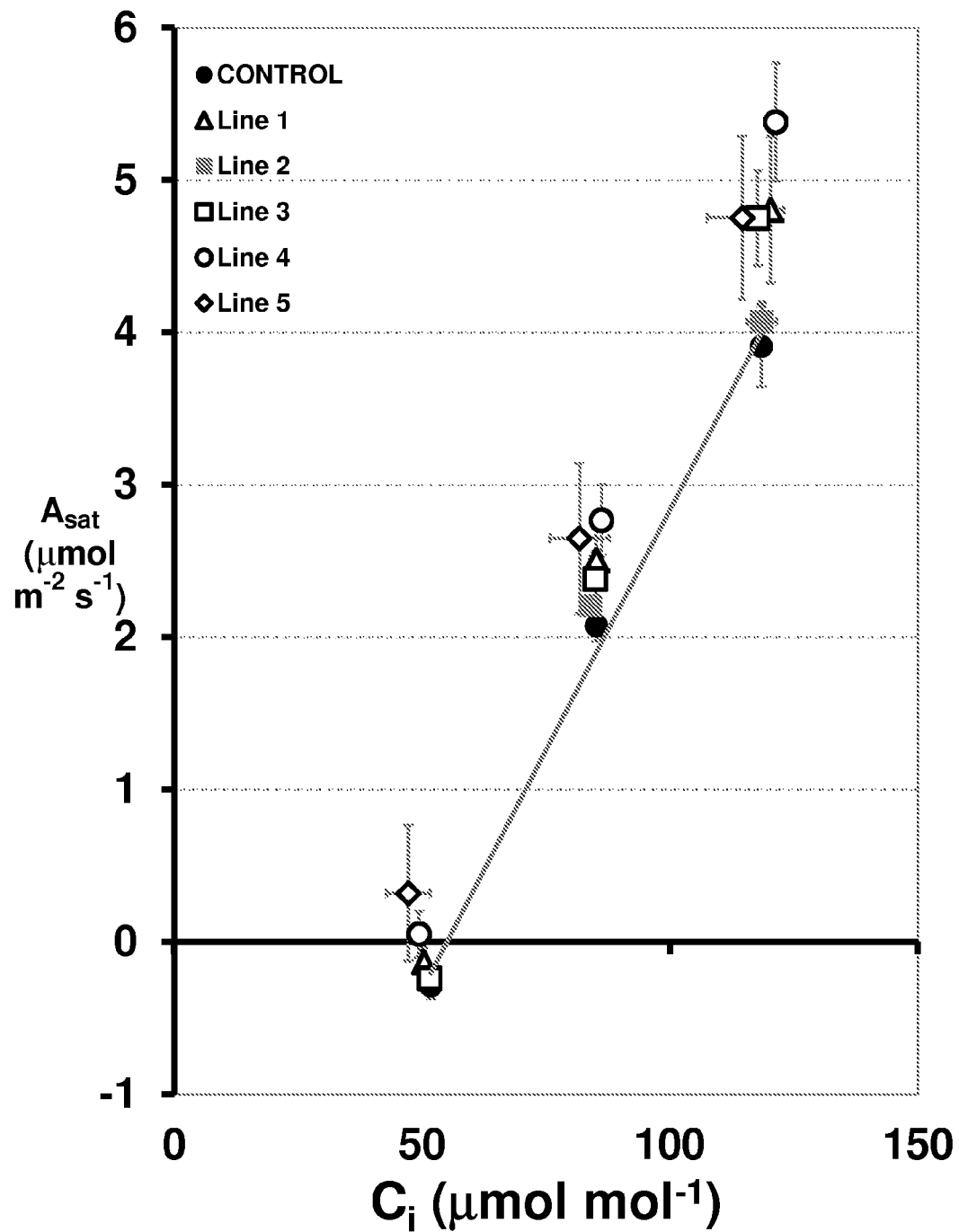

FIG. 22 shows increased rate of light saturated photosynthesis ($A_{sat}$) over a range of leaf, sub-stomatal $CO_2$ concentration ($C_i$) in five AtMYC1 overexpression lines (line 1-5), compared to a control line. Data were collected over a range of $C_i$ over which the activity of Rubisco is known to limit $A_{sat}$. The solid line shown is a regression fitted to the data for the control line only. All data are the means±1 standard error for data collected on at least 6 replicate plants for each line. Control line is represented by the solid black circles (●). Line 1 is represented by open triangles (Δ). Line 2 is represented by solid squares (■). Line 3 is represented by open squares (□). Line 4 is represented by open circles (○). Line 5 is represented by open diamonds (◇).

Figure 23:
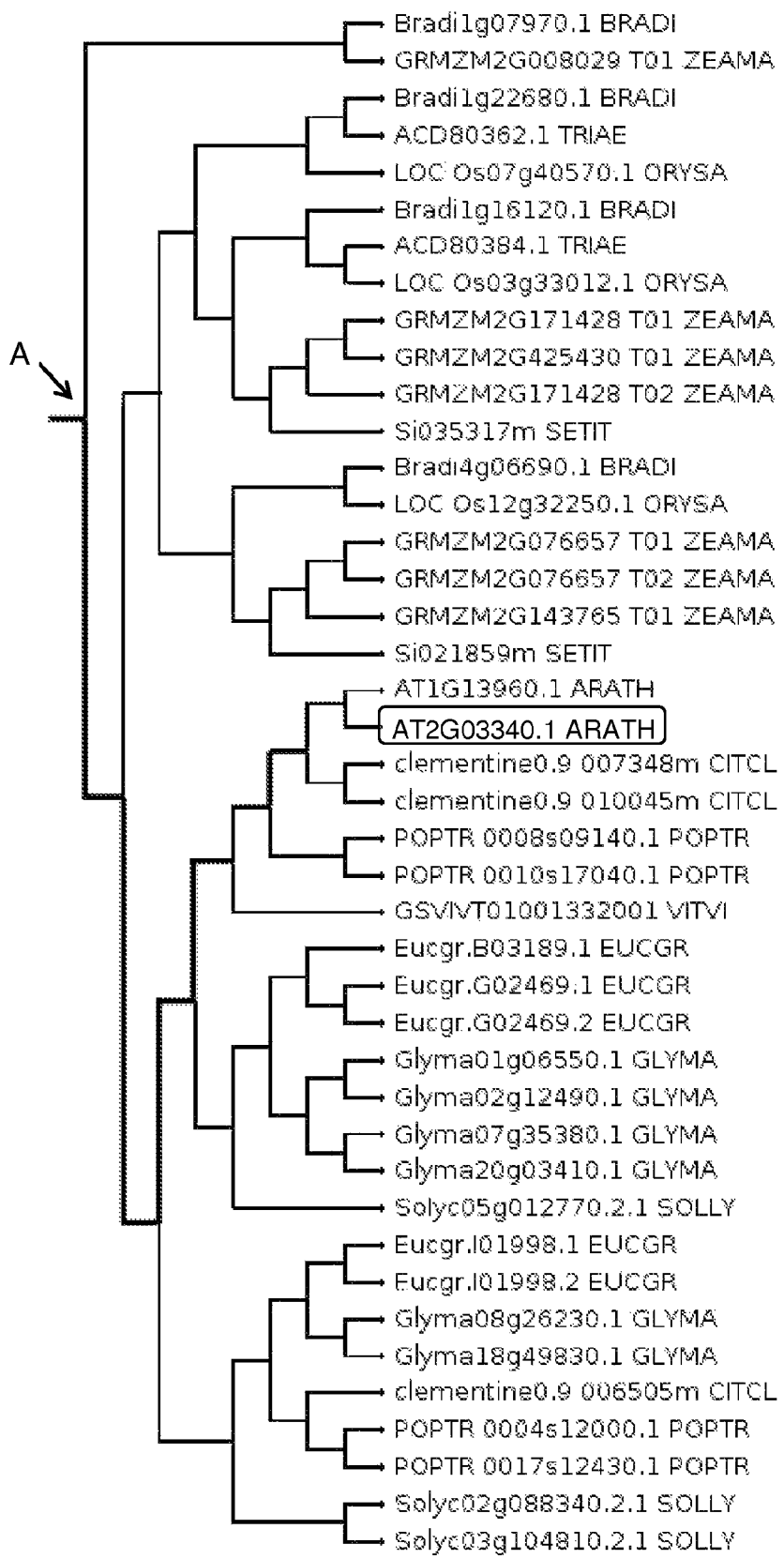

In FIG. 23, a phylogenetic tree of WRKY3 or AT2G03340.1 (also referred to as G878) clade members were constructed using TreeBeST (Ruan et al., 2008. *Nucleic Acids Res.* 36 (suppl. 1): D735-D740) using the best command to identify the best tree from maximum likelihood and neighbor joining methods. WRKY3 (AT2G03340.1) appears in the rounded rectangle. An ancestral sequence of WRKY3 and closely-related sequences is represented by the node of the tree indicated by the arrow "A" in FIG. 23. WRKY3 clade members are considered those proteins that descended from ancestral sequence "A", including the exemplary sequences shown in this figure that are bounded by Bradi1g07970.1 and Solyc03g104810.2.1.

FIGS. 24A-24O show an alignment of WRKY3 and representative clade-related proteins. The WRKY3 clade sequences are identified within the bracket along the left-hand side of the sequences. The alignment was generated with MUSCLE v3.8.31 with default parameters. SEQ ID NOs: appear in parentheses after each Gene Identifier (GID). The conserved first and second WRKY domains of WRKY3 polypeptide clade members appear in boxes with the dashed line boundaries in FIG. 24G-24H and FIG. 24K-24L, respectively. Consensus SEQ ID NO: 1299 spans FIG. 24G-24H. Consensus SEQ ID NO: 1299 spans FIG. 24K-24L.

Figure 25:
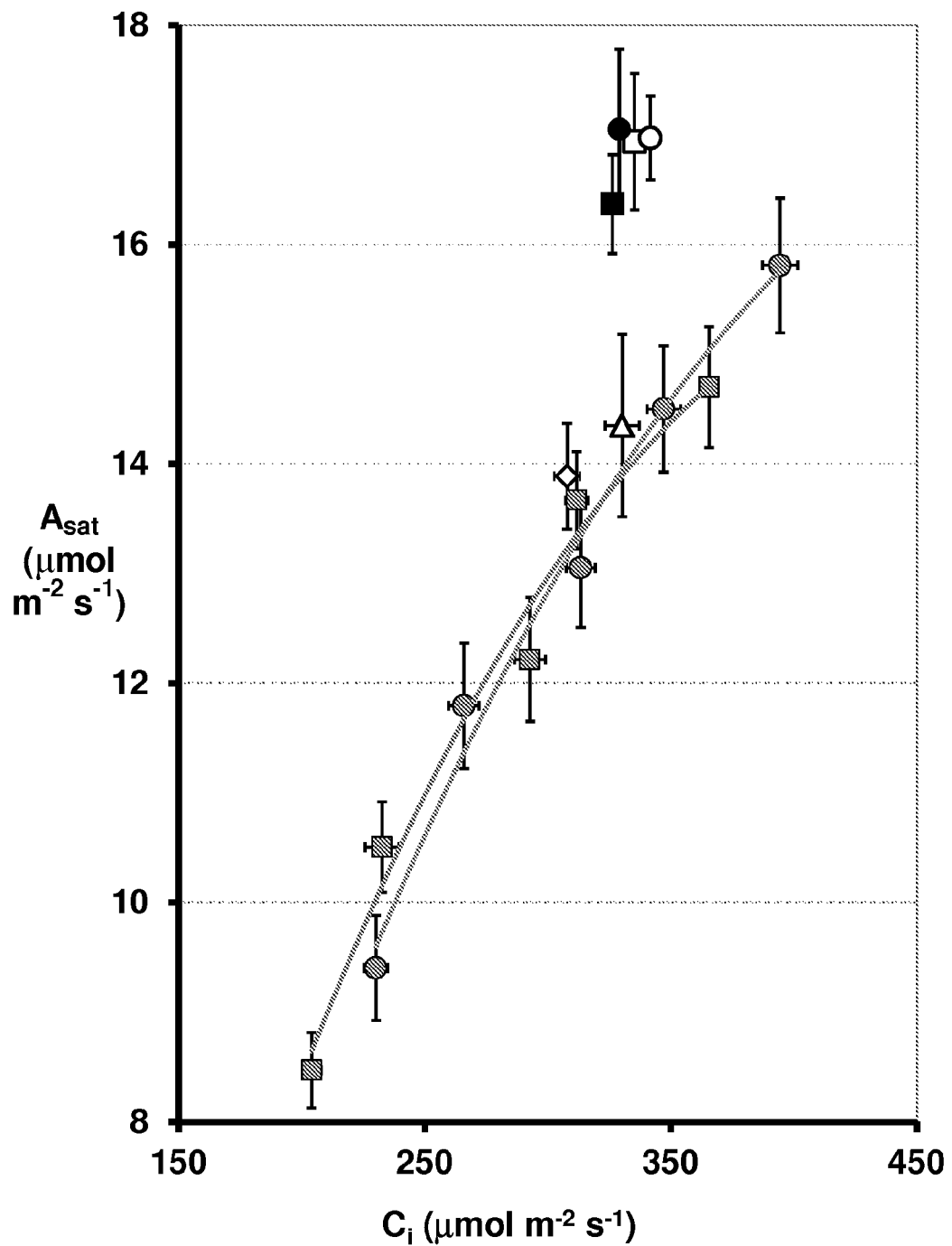

FIG. 25 shows the photosynthetic capacity of WRKY3 overexpressors at 22° C. This plot shows the increased rate of light-saturated photosynthesis ($A_{sat}$) at a given leaf, sub-stomatal $CO_2$ concentration ($C_i$) for an empty-vector control line (e.g., plants that did not comprise a recombinant construct encoding a WRKY3-related polypeptide or over-express a WRKY3 clade or phylogenetically-related regulatory protein and described below simply as 'control') and four independent WRKY3 overexpression lines. The data presented were collected during two independent experiments and after 40 minutes of acclimation to a photosynthetically-active radiation (PAR), intensity of 700 μmol PAR $m^{-2}$ $s^{-1}$, known to be saturating for photosynthesis, at an air temperature of 22° C. The data presented are the means±1 standard error for data collected on at least seven replicate plants for each line. Gray circles (●) refer to Control (1); gray squares (■) show results for Control (2); white triangles (Δ) show results for WRKY3-line 1 (1); white squares (□) show results for WRKY3-line 2 (1); black squares (■) show results for WRKY3-line 2 (2); white circles (○) show results for WRKY3-line 3 (1), black circles (●) show results for WRKY3-line 3 (2), and white diamonds (◇) show results for WRKY3-line 4 (2). Lines identified with a '1' in parentheses in the figure legend were screened in the first experiment, lines identified with a '2' in parentheses were screened in the second experiment.

Figure 26:
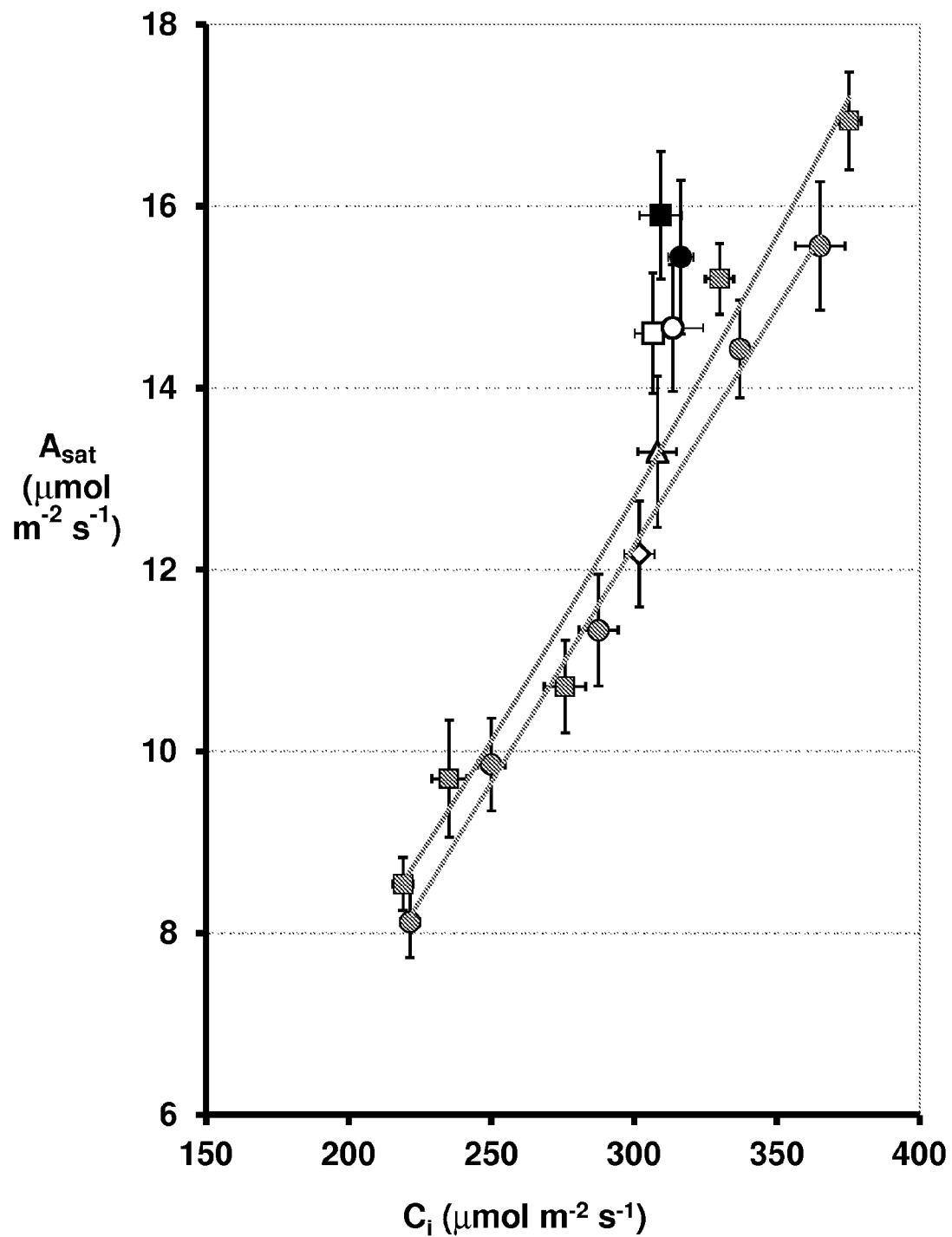

FIG. 26 Photosynthetic capacity at 35° C.: Plot showing increased rate of light-saturated photosynthesis ($A_{sat}$) at a given leaf, sub-stomatal $CO_2$ concentration ($C_i$) for a control line and four independent WRKY3 overexpression lines. Data presented were collected during two independent experiments and after 40 minutes acclimation to a photosynthetically-active radiation (PAR), intensity of 700 μmol PAR $m^{-2}$ $s^{-1}$, known to be saturating for photosynthesis, at an air temperature of 35° C. All data are the means±1 standard error for data collected on at least seven replicate plants for each line. In the same identification scheme of FIG. 25, gray circles (●) refer to Control (1); gray squares (■) show results for Control (2); white triangles (Δ) show results for WRKY3-line 1 (1); white squares (□) show results for WRKY3-line 2 (1); black squares (■) show results for line 2 (2); white circles (○) show results for WRKY3-line 3 (1), black circles (●) show results for WRKY3-line 3 (2), and white diamonds (◇) show results for WRKY3-line 4 (2). Lines identified with a '1' in parentheses in the figure legend, were screened in the first experiment, lines identified with a '2' in parentheses were screened in the second experiment.

Figure 27:
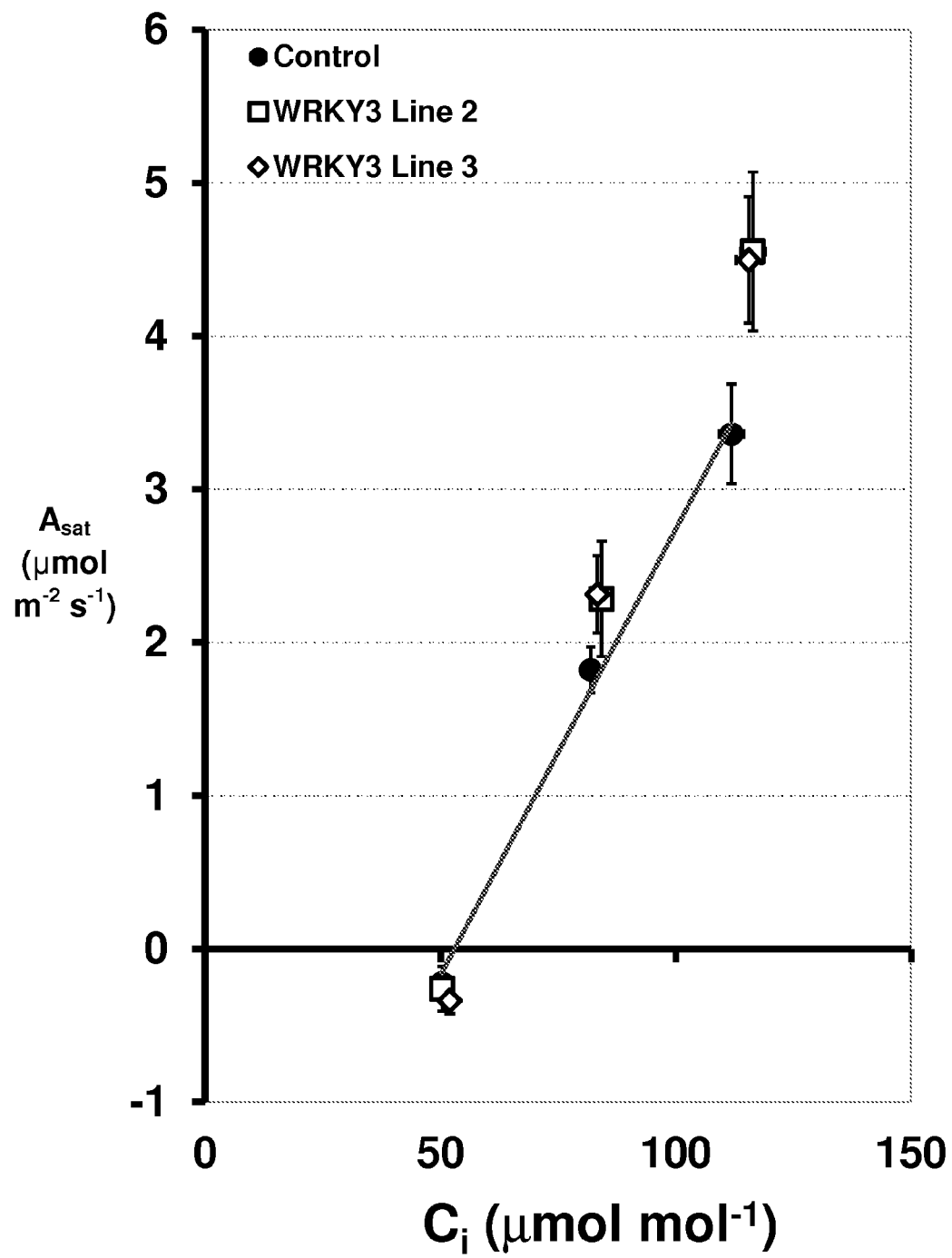

FIG. 27 shows increased light saturated photosynthesis ($A_{sat}$) over a range of leaf sub-stomatal $CO_2$ concentration ($C_i$), in two WRKY3 overexpression lines (lines 2 and 3), compared to a control line. Data were collected over a range of $C_i$ over which the activity of Rubisco is known to limit $A_{sat}$. The solid line shown is a regression fitted to the data for the control line only. All data are the means±1 standard error for data collected on at least 6 replicate plants for each line. Control line is represented by solid black circles (●). Line 2 is represented by open squares (□). Line 3 is represented by open diamonds (◇).

Figure 28:
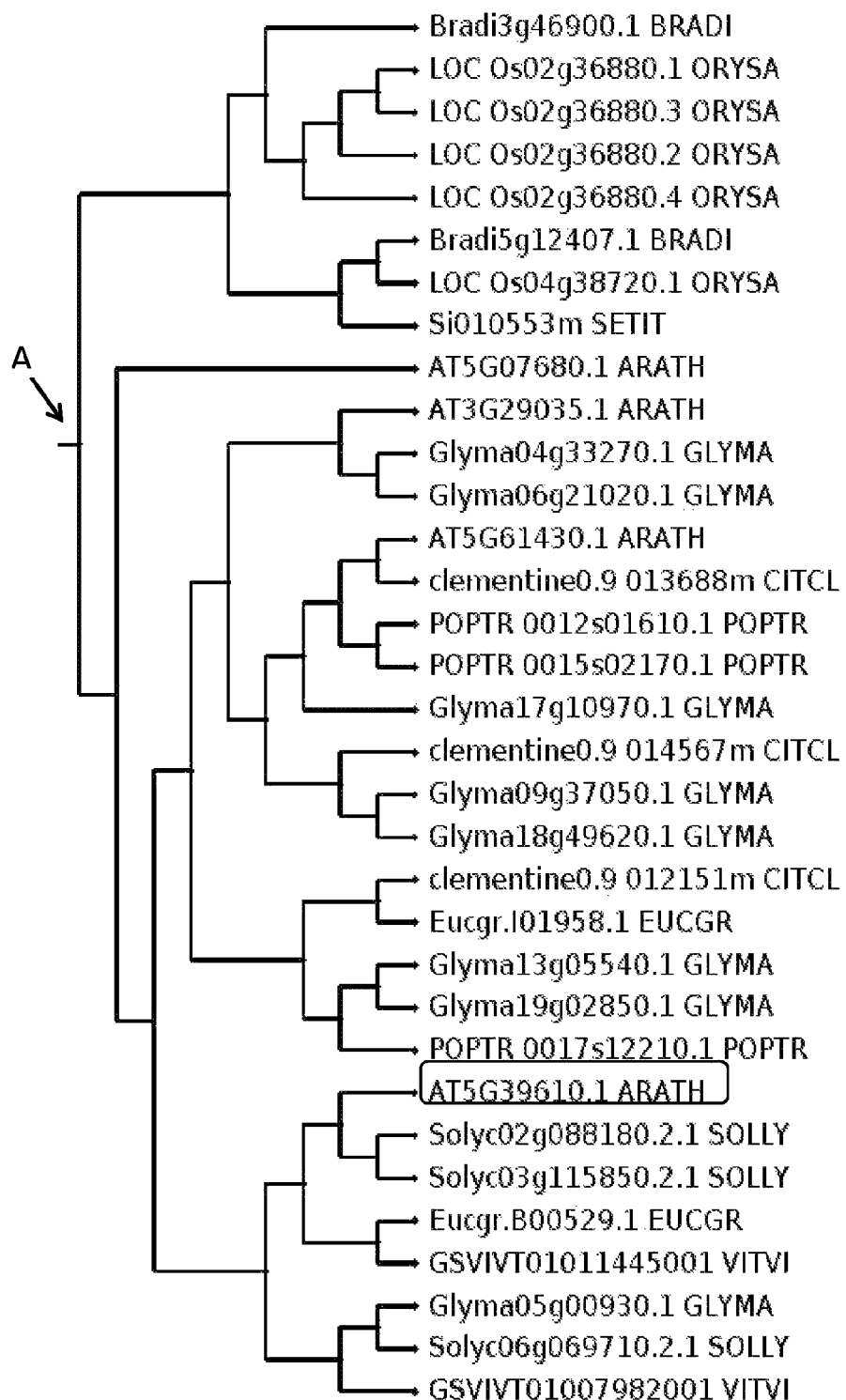

In FIG. 28, a phylogenetic tree of the AtNAC6 or AT5G39610 (also referred to as G525) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. AtNAC6 (AT5G39610) appears in the rounded rectangle. An ancestral sequence of AtNAC6 and closely-related sequences is represented by the node of the tree indicated by the arrow "A" in FIG. 28. AtNAC6 clade members are considered those proteins that descended from ancestral sequence "A", including the exemplary sequences shown in this figure that are bounded by Bradi3g46900.1 and GSVIVT01007982001.

FIGS. 29A-29I show an alignment of AtNAC6 and representative clade-related proteins. The AtNAC6 clade sequences are identified within the bracket along the left-hand side of the sequences. The alignment was generated with MUSCLE v3.8.31 with default parameters. SEQ ID NOs: appear in parentheses after each Gene Identifier (GID). The conserved NAM Domains appear in boxes with the dashed line boundaries in FIG. 29A-29C. A clade consensus sequence (SEQ ID NO: 1467) comprising conserved residues of the NAM domains is shown in the last row in FIG.

29A-29C. Two small consensus sequences (SEQ ID NOs: 1468 and 1469) are also shown in the last row of in FIGS. 29D and 29E, respectively.

Figure 30:
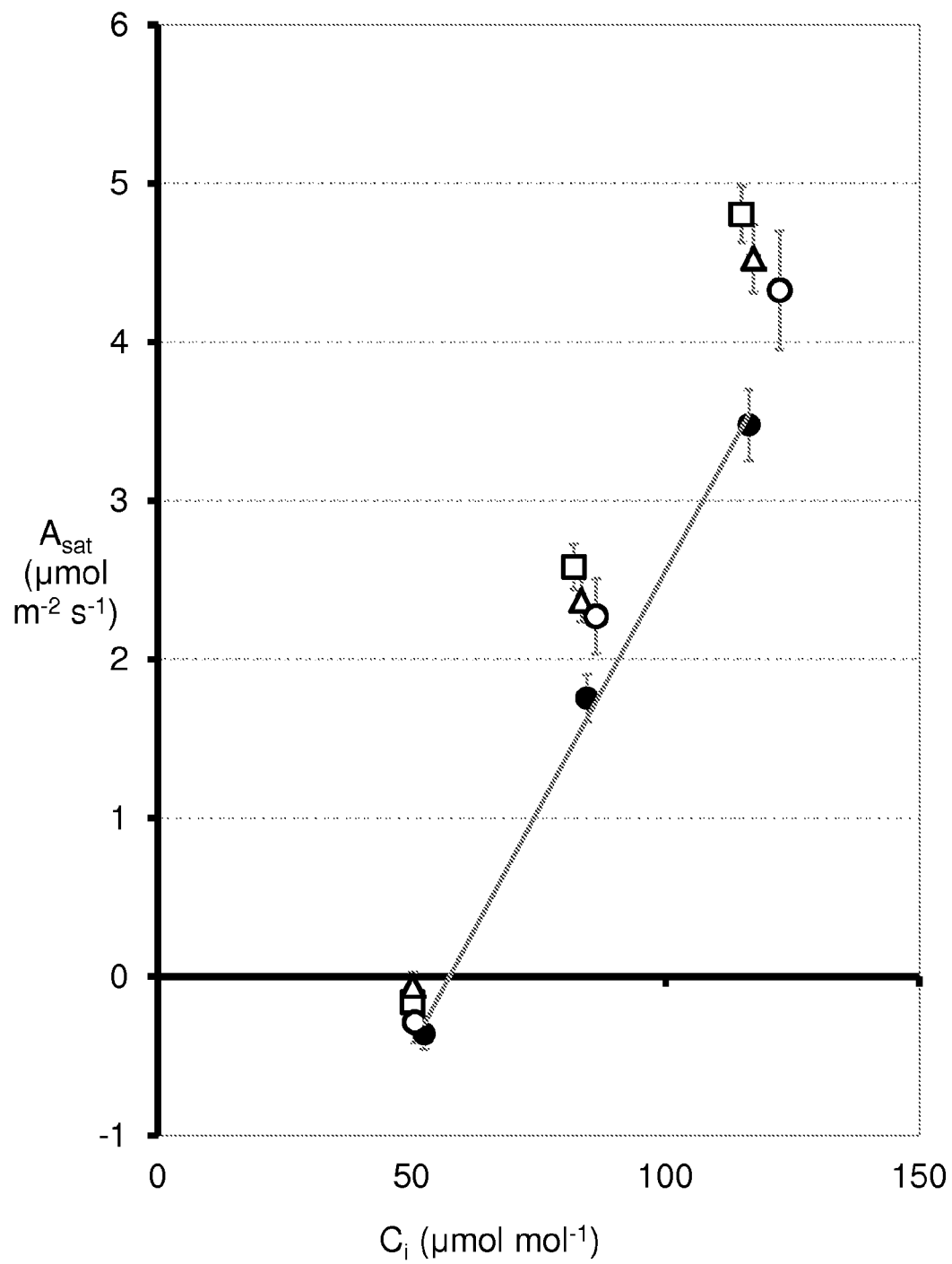

FIG. 30 illustrates Rubisco limited photosynthetic capacity of *Arabidopsis* plants in a plot showing increased light-saturated photosynthesis ($A_{sat}$) over a range of leaf, sub-stomatal $CO_2$ concentration ($C_i$), in three AtNAC6 overexpression lines, as compared to a control line. Data were collected over a range of $C_i$ over which the activity of Rubisco is known to limit $A_{sat}$. The solid line shown is a regression fitted to the data for the control line only. All data are the means±1 standard error for data collected on at least six replicate plants for each line.

Figure 31:
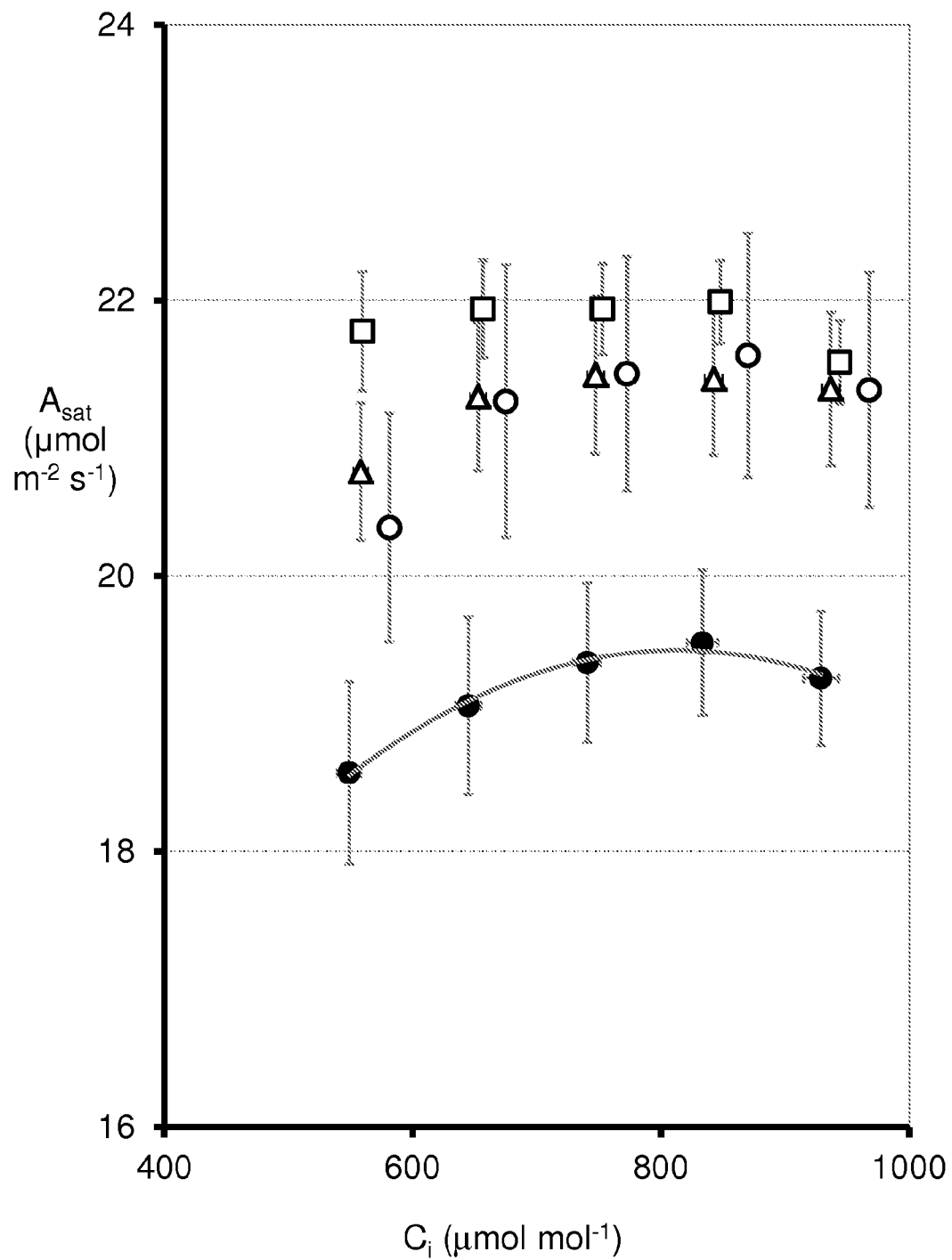

FIG. 31 illustrates RuBP-regeneration limited photosynthetic capacity of *Arabidopsis* plants in a plot showing increased light-saturated photosynthesis ($A_{sat}$) over a range of leaf, sub-stomatal $CO_2$ concentration ($C_i$), in three AtNAC6 overexpression lines, compared to a control line. Data were collected over a range of $C_i$ over which the capacity to regenerate RuBP is known to limit $A_{sat}$. The solid line shown is a regression fitted to the data for the control line only. All data are the means±1 standard error for data collected on at least six replicate plants for each line.

Legend for FIG. 30 and FIG. 31:
● Control:
☐ AtNAC6-Line 1
Δ AtNAC6-Line 3
○ AtNAC6-Line 4

Figure 32:
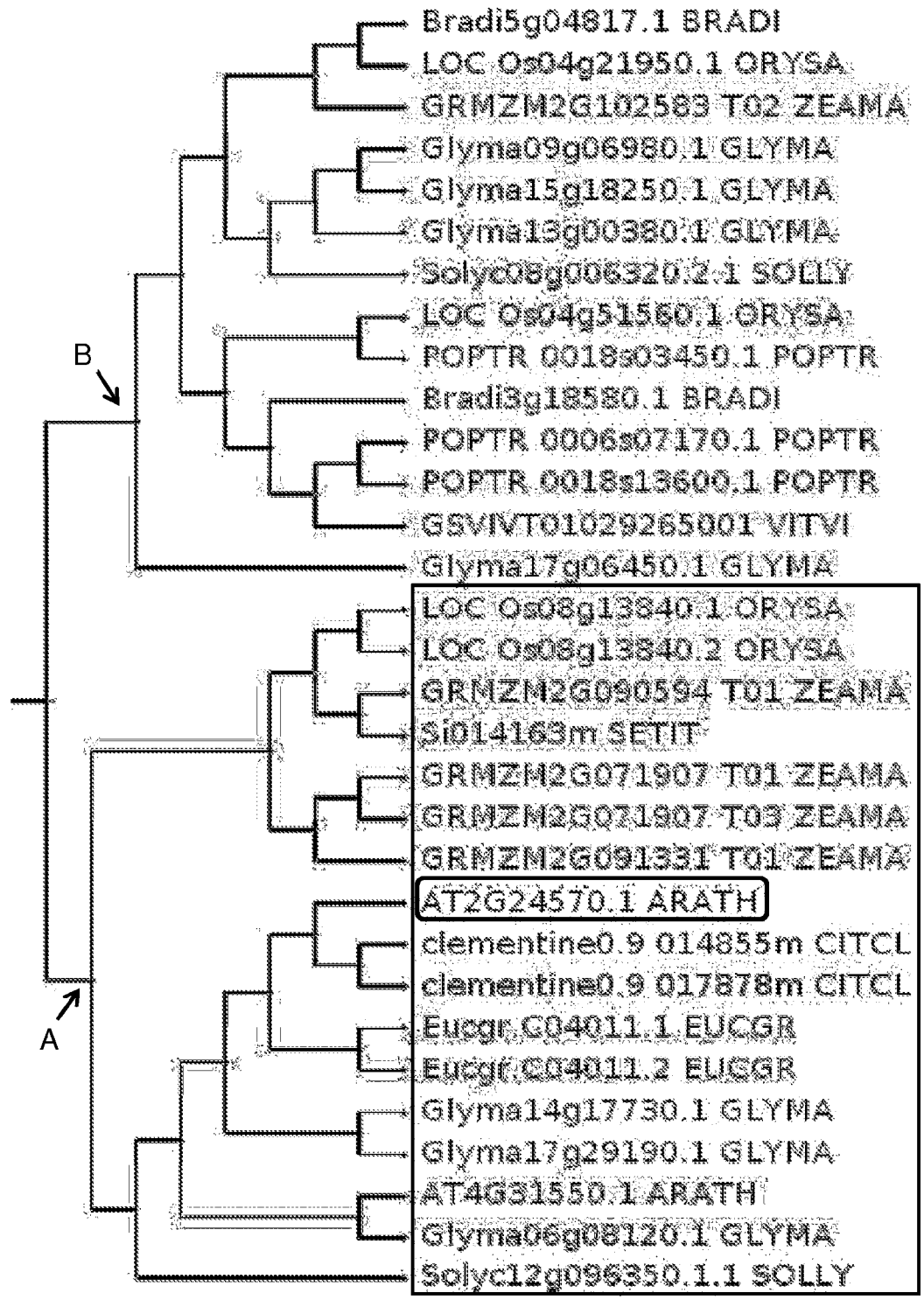

In FIG. 32, a phylogenetic tree of WRKY17 or AT2G24570.1 (also referred to as G866) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. The WRKY17 clade members appear in the large box with the solid line boundary. WRKY17 (AT2G24570) appears in the rounded rectangle. An ancestral sequence of WRKY17 and closely-related WRKY17 clade sequences is represented by the node of the tree indicated by the arrow "A" in FIG. 32. WRKY17 clade members are considered those proteins that descended from ancestral sequence "A", including the exemplary sequences shown in this figure that are bounded by LOC_Os08g13840.1 and Solyc12g096350.1.1 (indicated by the box around these sequences). A related clade is represented by the node indicated by arrow "B".

FIGS. 33A-33H show an alignment of WRKY17 and representative clade-related proteins. The WRKY17 clade sequences are identified within the box around the first 13 listed Sequence Identifiers. The alignment was generated with MUSCLE v3.8.31 with default parameters. SEQ ID NOs: appear in parentheses after each Gene Identifier (GID). The conserved "Plant Zinc Cluster Domain" and "WRKY DNA-binding Domain" appear in boxes with the dashed line boundaries in FIGS. 33E-33F and 33F-33G, respectively. Two consensus sequences comprising conserved residues are shown in the last row in FIG. 33B (single underlined SEQ ID NO: 1558 and double underlined SEQ ID NO: 1559) and FIG. 33F-33G (single underlined SEQ ID NO: 1560 and double underlined SEQ ID NO: 1561).

Figure 34:
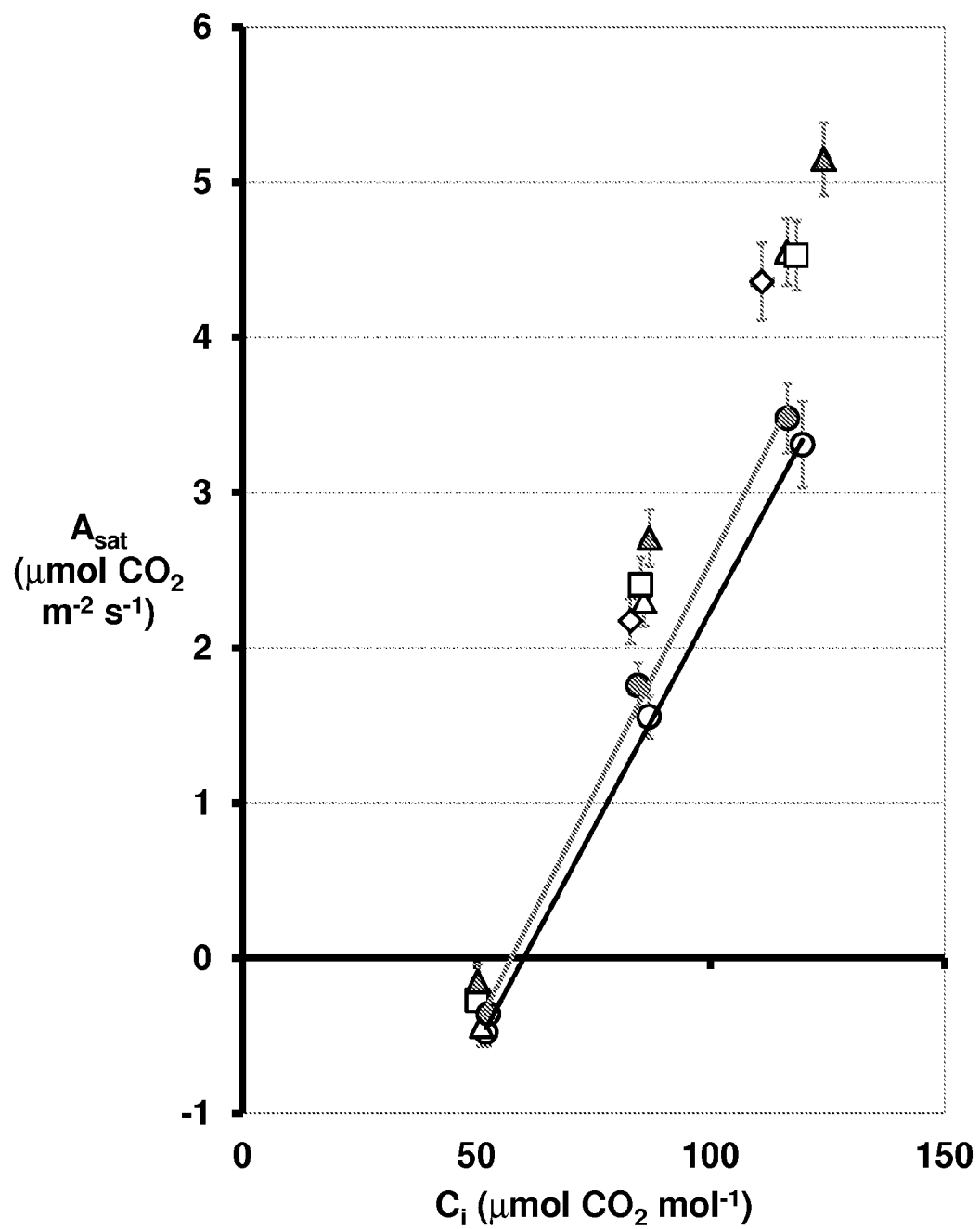

FIG. 34 is a plot of photosynthetic capacity at growth temperature showing increased light-saturated photosynthesis ($A_{sat}$) over a range of leaf, sub-stomatal CO2 concentration ($C_i$), in three independent WRKY17 overexpression lines and a control line. Data were collected over a range of $C_i$ over which the activity of Rubisco is known to limit $A_{sat}$. Data labeled as 'repeat' was collected in an independent experiment. The solid lines shown are a regression fitted to the data for the control line only. All data are the means±1 standard error for data collected on at least six replicate plants for each line.

Legend for FIG. 34:
○ Control
Δ WRKY17-Line 1
◇ WRKY17-Line 2
☐ WRKY17-Line 3
⊙ Control (repeat)
▲ WRKY17-Line 1 (repeat)

Figure 35:
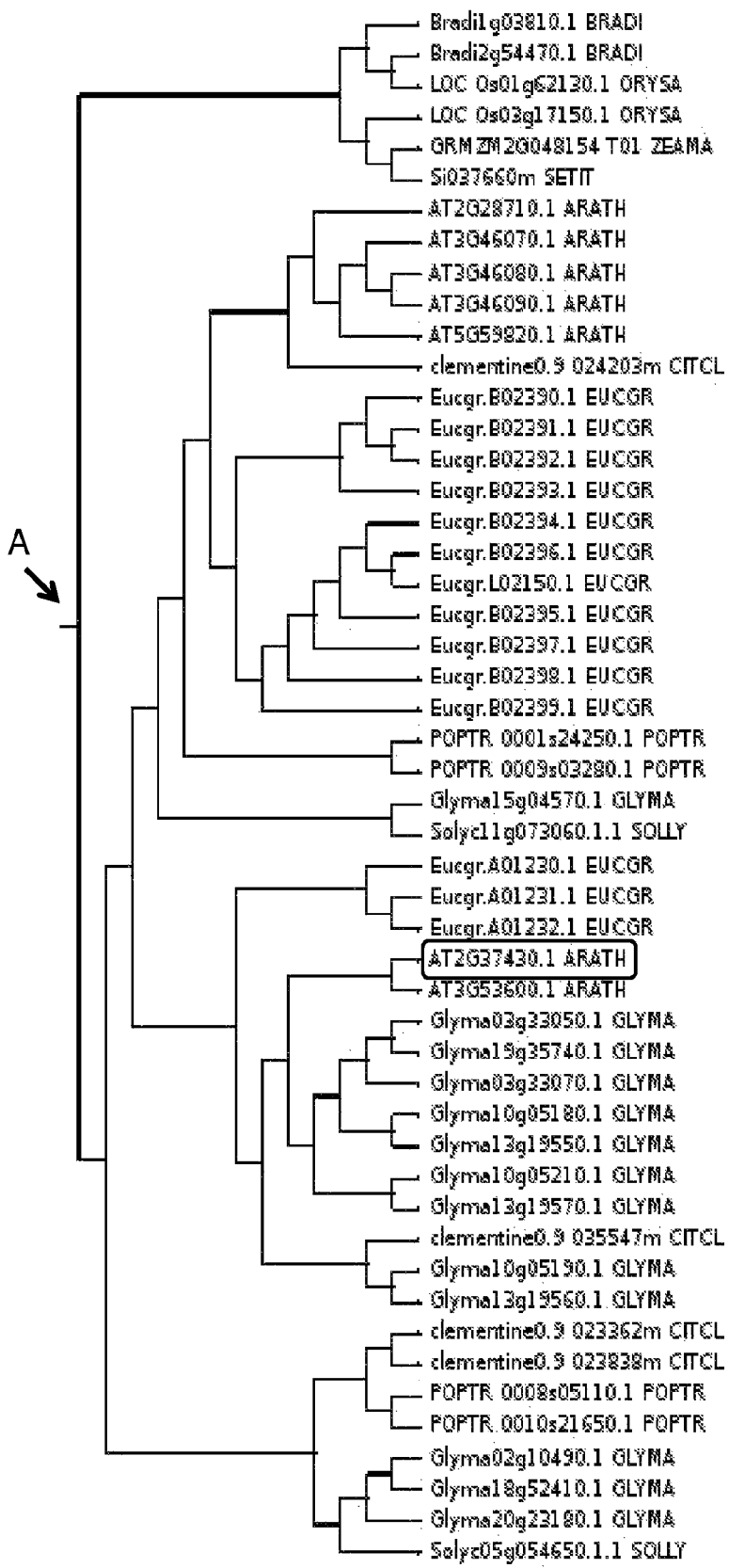

In FIG. 35, a phylogenetic tree of ZAT11 or AT2G37430 (also referred to as G355) clade members and related full length proteins were constructed using TreeBeST (Ruan et al., 2008. *Nucleic Acids Res.* 36 (suppl. 1): D735-D740) using the best command to identify the best tree from maximum likelihood and neighbor joining methods. ZAT11 (AT2G37430.1) appears in the rounded rectangle. An ancestral sequence of ZAT11 and closely-related sequences is represented by the node of the tree indicated by the arrow "A" in FIG. 35. ZAT11 clade members are considered those proteins that descended from ancestral sequence "A", including the exemplary sequences shown in this figure that are bounded by Bradi1g03810.1 and Solyc05g054650.1.1.

FIGS. 36A-36E show an alignment of ZAT11 and representative clade-related proteins. ZAT11 clade sequences are identified within the bracket along the right-hand side of the sequences. The alignment was generated with MUSCLE v3.8.31 with default parameters. SEQ ID NOs: appear in parentheses after each Gene Identifier (GID). The conserved first and second Z-C2H2 domains appear in boxes in FIG. 36B and FIGS. 36C-36D, respectively (comprising consensus sequences SEQ ID NOs 1646 and 1647). A distinct motif and its consensus sequence (SEQ ID NO: 1648) that is found with these clade members is shown in the last lines of FIG. 36D-36E.

Figure 37:
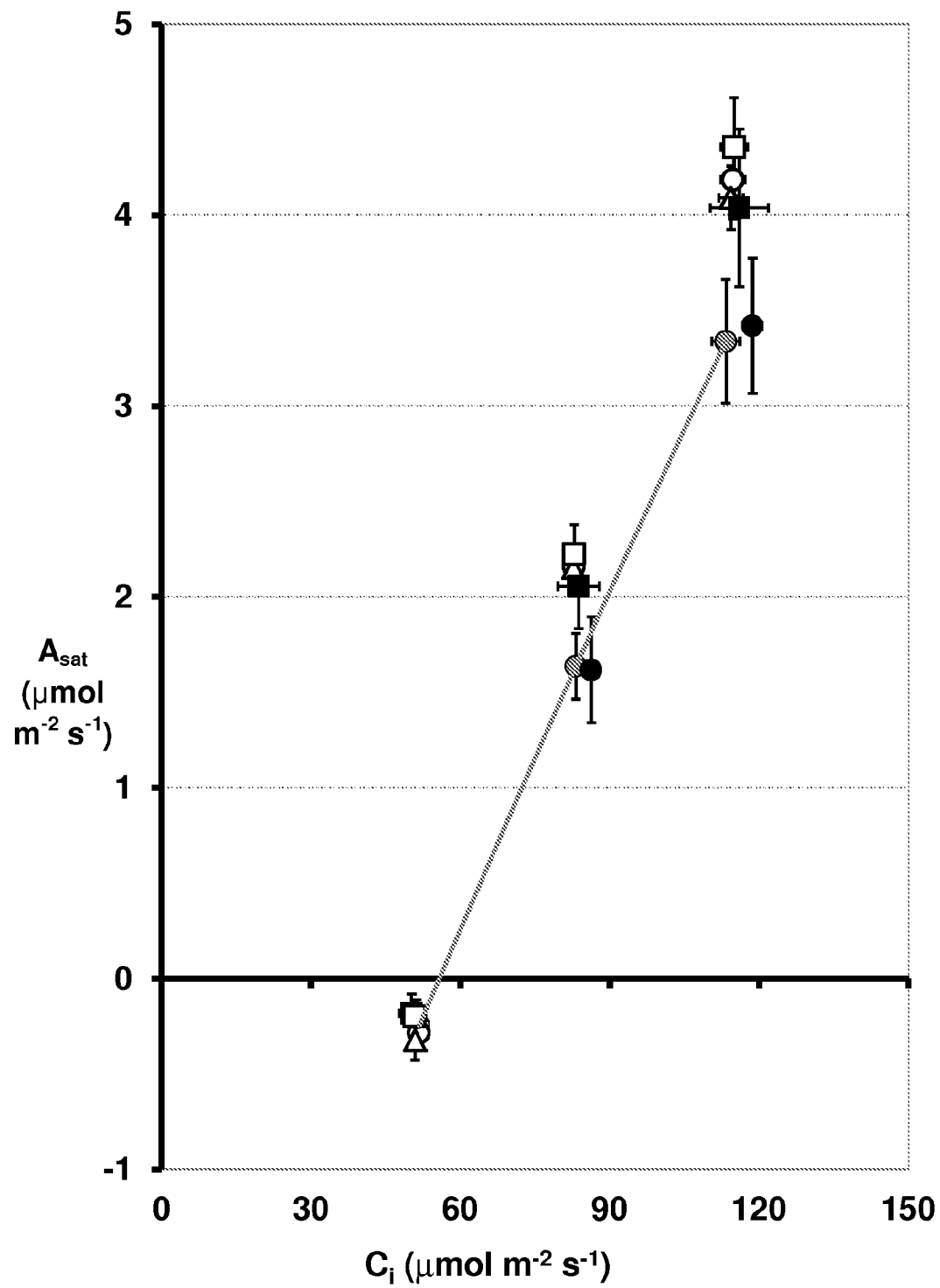

FIG. 37 shows increased light saturated photosynthesis ($A_{sat}$) over a range of leaf sub-stomatal $CO_2$ concentrations ($C_i$), in four out of five ZAT11 overexpression lines, compared to a control line. Data were collected over a range of $C_i$ over which the activity of Rubisco is known to limit $A_{sat}$. The solid line shown is a regression fitted to the data for the control line only. All data are the means±1 standard error for data collected on at least six replicate plants for each line.

Legend for FIG. 37:
⊙ Control
○ ZAT11-Line 1
● ZAT11-Line 2
Δ ZAT11-Line 3
■ ZAT11-Line 4
☐ ZAT11-Line 5

DETAILED DESCRIPTION

The present description relates to polynucleotides and polypeptides for modifying phenotypes of plants, particularly those associated with increased photosynthetic resource use efficiency and increased yield with respect to a control plant (for example, a wild-type plant). Throughout this disclosure, various information sources are referred to and/or are specifically incorporated. The information sources include scientific journal articles, patent documents, textbooks, and internet entries. While the reference to these information sources clearly indicates that they can be used by one of skill in the art, each and every one of the information sources cited herein are specifically incorporated in their entirety, whether or not a specific mention of "incorporation by reference" is noted. The contents and teachings of each and every one of the information sources can be relied on and used to make and use embodiments of the instant description.

As used herein and in the appended claims, the singular forms "a", "an", and "the" include the plural reference unless the context clearly dictates otherwise. Thus, for example, a reference to "a host cell" includes a plurality of such host cells, and a reference to "a plant" is a reference to one or more plants, and so forth.

A "recombinant polynucleotide" is a polynucleotide that is not in its native state, e.g., the polynucleotide comprises a nucleotide sequence not found in nature, or the polynucleotide is in a context other than that in which it is naturally found, e.g., separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acid.

A "polypeptide" is an amino acid sequence comprising a plurality of consecutive polymerized amino acid residues e.g., at least about 15 consecutive polymerized amino acid residues. In many instances, a polypeptide comprises a polymerized amino acid residue sequence that is a regulatory polypeptide or a domain or portion or fragment thereof. Additionally, the polypeptide may comprise: (i) a localization domain; (ii) an activation domain; (iii) a repression domain; (iv) an oligomerization domain; (v) a protein-protein interaction domain; (vi) a DNA-binding domain; or the like. The polypeptide optionally comprises modified amino acid residues, naturally occurring amino acid residues not encoded by a codon, or non-naturally occurring amino acid residues.

"Protein" refers to an amino acid sequence, oligopeptide, peptide, polypeptide or portions thereof whether naturally occurring or synthetic.

In the instant description, "exogenous" refers to a heterologous nucleic acid or polypeptide that may not be naturally expressed in a plant of interest. Exogenous nucleic acids may be introduced into a plant in a stable or transient manner via, for example, transformation or breeding, and may thus serve to produce in planta a homologous RNA molecule and an encoded and functional polypeptide. Exogenous nucleic acids and polypeptides introduced thusly may comprise sequences that are wholly or partially identical or homologous to sequences that naturally occur in (i.e., that are endogenous with respect to) the plant.

A "recombinant polypeptide" is a polypeptide produced by translation of a recombinant polynucleotide. A "synthetic polypeptide" is a polypeptide created by consecutive polymerization of isolated amino acid residues using methods well known in the art. An "isolated polypeptide," whether a naturally occurring or a recombinant polypeptide, is more enriched in (or out of) a cell than the polypeptide in its natural state in a wild-type cell, e.g., more than about 5% enriched, more than about 10% enriched, or more than about 20%, or more than about 50%, or more, enriched, i.e., alternatively denoted: 105%, 110%, 120%, 150% or more, enriched relative to wild type standardized at 100%. Such an enrichment is not the result of a natural response of a wild-type plant. Alternatively, or additionally, the isolated polypeptide is separated from other cellular components with which it is typically associated, e.g., by any of the various protein purification methods herein.

"Identity" or "similarity" refers to sequence similarity between two polynucleotide sequences or between two polypeptide sequences, with identity being a more strict comparison. The phrases "percent identity" and "% identity" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar or identical, or any integer value between 0-100%. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polyBLAST nucleotide sequences is a function of the number of identical, matching or corresponding nucleotides at positions shared by the polynucleotide sequences. A degree of identity of polypeptide sequences is a function of the number of identical amino acids at corresponding positions shared by the polypeptide sequences. A degree of homology or similarity of polypeptide sequences is a function of the number of amino acids at corresponding positions shared by the polypeptide sequences. The fraction or percentage of components in common is related to the homology or identity between the sequences. Alignments such as those of 2A-2I, 6A-6J, 8A-8I, 11A-11H, 14A-14L, 16A-16J, 18A-18L, 21A-21O, 24A-24O, 29A-29I, 33A-33H, and 36A-36E may be used to identify conserved domains and relatedness within these domains. An alignment may suitably be determined by means of computer programs known in the art, such as MACVECTOR software, (1999; Accelrys, Inc., San Diego, Calif.).

"Homologous sequences" refers to polynucleotide or polypeptide sequences that are similar due to common ancestry and sequence conservation. The terms "ortholog" and "paralog" are defined below in the section entitled "Orthologs and Paralogs". In brief, orthologs and paralogs are evolutionarily related genes that have similar sequences and functions. Orthologs are structurally related genes in different species that are derived by a speciation event. Paralogs are structurally related genes within a single species that are derived by a duplication event.

"Functional homologs" are polynucleotide or polypeptide sequences, including orthologs and paralogs, that are similar due to common ancestry and sequence conservation and have identical or similar function at the catalytic, cellular, or organismal levels. The presently disclosed AtNAC6 clade, WRKY17 clade, AtNPR3 clade, AtMYC1 clade, AtMYB19 clade, ERF058 clade, CRF1 clade, WRKY3 clade, ZAT11 clade, MYB111 clade, SPATULA clade, and AtMYB50 clade polypeptides are "functionally-related and/or closely-related" by having descended from a common ancestral sequence (from the node shown by arrow A in FIGS. 1, 5, 7, 10, 13, 15, 17, 20, 23, 28, 32, and 35), and/or by being sufficiently similar to the sequences and domains listed in Tables 2 through 21 that they confer the same function to plants of increased photosynthetic resource use efficiency and associated improved plant vigor, quality, yield, size, and/or biomass.

Functionally-related and/or closely-related polypeptides may be created artificially, semi-synthetically, or may occur naturally by having descended from the same ancestral sequence as the disclosed AtNAC6, WRKY17, AtNPR3, AtMYC1, AtMYB19, ERF058, CRF1, WRKY3, ZAT11, MYB111, SPATULA, and AtMYB50-related sequences, where the polypeptides have the function of conferring increased photosynthetic resource use efficiency to plants.

"Conserved domains" are recurring units in molecular evolution, the extents of which can be determined by sequence and structure analysis. A "conserved domain" or "conserved region" as used herein refers to a region in heterologous polynucleotide or polypeptide sequences where there is a relatively high degree of sequence identity between the distinct sequences. Conserved domains contain conserved sequence patterns or motifs that allow for their detection in, and identification and characterization of, polypeptide sequences. The NAM domain, Plant Zinc Cluster domain, BTB domain, bHLH-MYC domain, Myb DNA binding domain, WRKY domain, C2H2-type zinc finger (Z-C2H2) domain, AP2 domain, HLH domain, SANT domain, ANK domain, HLH domain, or Myb DNA binding domain, are examples of conserved domains.

A transgenic plant is expected to have improved or increased photosynthetic resource use efficiency relative to a control plant when the transgenic plant is transformed with a recombinant polynucleotide encoding any of the listed sequences or another AtNAC6 clade, WRKY17 clade, AtNPR3 clade, AtMYC1 clade, AtMYB19 clade, ERF058 clade, CRF1 clade, WRKY3 clade, ZAT11 clade, MYB111 clade, SPATULA clade, and AtMYB50 clade sequence, or when the transgenic plant contains or expresses a polypeptide sequence of the AtNAC6 clade, WRKY17 clade, AtNPR3 clade, AtMYC1 clade, AtMYB19 clade, ERF058 clade, CRF1 clade, WRKY3 clade, ZAT11 clade, MYB111 clade, SPATULA clade, and AtMYB50 clades.

The terms "highly stringent" or "highly stringent condition" refer to conditions that permit hybridization of DNA strands whose sequences are highly complementary, wherein these same conditions exclude hybridization of significantly mismatched DNAs. Polynucleotide sequences capable of hybridizing under stringent conditions with the polynucleotides of the present description may be, for example, variants of the disclosed polynucleotide sequences, including allelic or splice variants, or sequences that encode orthologs or paralogs of presently disclosed polypeptides. Nucleic acid hybridization methods are disclosed in detail by Kashima et al., 1985. *Nature* 313: 402-404; Sambrook et al., 1989. *Molecular Cloning: A Laboratory Manual*, 2nd Ed., Cold Spring Harbor Laboratory, Cold Spring Harbor, N.Y., and by Haymes et al., 1985. *Nucleic Acid Hybridization: A Practical Approach*, IRL Press, Washington, D.C., which references are incorporated herein by reference.

In general, stringency is determined by the temperature, ionic strength, and concentration of denaturing agents (e.g., formamide) used in a hybridization and washing procedure (for a more detailed description of establishing and determining stringency, see the section "Identifying Polynucleotides or Nucleic Acids by Hybridization", below). The degree to which two nucleic acids hybridize under various conditions of stringency is correlated with the extent of their similarity. Thus, similar nucleic acid sequences from a variety of sources, such as within a plant's genome (as in the case of paralogs) or from another plant (as in the case of orthologs) that may perform similar functions can be isolated on the basis of their ability to hybridize with known related polynucleotide sequences. Numerous variations are possible in the conditions and means by which nucleic acid hybridization can be performed to isolate related polynucleotide sequences having similarity to sequences known in the art and are not limited to those explicitly disclosed herein. Such an approach may be used to isolate polynucleotide sequences having various degrees of similarity with disclosed polynucleotide sequences, such as, for example, encoded regulatory polypeptides also having at least 28% identity to SEQ ID NO: 1369, 1507, 864, 1016, 2, 490, 307, 1156, 1591, 735, 625, or 135, and/or at least 37% identity to a NAM domain, Plant Zinc Cluster domain, BTB domain, bHLH-MYC domain, Myb DNA binding domain, WRKY domain, C2H2-type zinc finger (Z-C2H2) domain, AP2 domain, HLH domain, ANK domain, or SANT domain of SEQ ID NO: 1369, 1507, 864, 1016, 2, 490, 307, 1156, 1591, 735, 625, or 135, increasing by steps of 1% to about 100%, identity with the conserved domains of disclosed sequences (see, for example, Tables 2-21 showing AtNAC6 clade, WRKY17 clade, AtNPR3 clade, AtMYC1 clade, AtMYB19 clade, ERF058 clade, CRF1 clade, WRKY3 clade, ZAT11 clade, MYB111 clade, SPATULA clade, and AtMYB50 clade polypeptides having at least 37%% acid identity with said domains of SEQ ID NO: 1369, 1507, 864, 1016, 2, 490, 307, 1156, 1591, 735, 625, or 135.

"Fragment", with respect to a polynucleotide, refers to a clone or any part of a polynucleotide molecule that retains a usable, functional characteristic. Useful fragments include oligonucleotides and polynucleotides that may be used in hybridization or amplification technologies or in the regulation of replication, transcription or translation. A "polynucleotide fragment" refers to any subsequence of a polynucleotide, typically, of at least about nine consecutive nucleotides, preferably at least about 30 nucleotides, more preferably at least about 50 nucleotides, of any of the sequences provided herein. Exemplary polynucleotide fragments are the first sixty consecutive nucleotides of the polynucleotides listed in the Sequence Listing. Exemplary fragments also include fragments that comprise a region that encodes an conserved domain of a polypeptide. Exemplary fragments also include fragments that comprise a conserved domain of a polypeptide. Exemplary fragments include fragments that comprise an conserved domain of a polypeptide, for example, of AtNAC6, WRKY17, AtNPR3, AtMYC1, AtMYB19, ERF058, CRF1, WRKY3, ZAT11, MYB111, SPATULA, or AtMYB50 (SEQ ID NO: 1369, 1507, 864, 1016, 2, 490, 307, 1156, 1591, 735, 625, or 135), or the amino acid residues of the domains listed in Tables 2 through 21.

Fragments may also include subsequences of polypeptides and protein molecules, or a subsequence of the polypeptide. Fragments may have uses in that they may have antigenic potential. In some cases, the fragment or domain is a subsequence of the polypeptide which performs at least one biological function of the intact polypeptide in substantially the same manner, or to a similar extent, as does the intact polypeptide. For example, a polypeptide fragment can comprise a recognizable structural motif or functional domain such as a DNA-binding site or domain that binds to a DNA promoter region, an activation domain, or a domain for protein-protein interactions, and may initiate transcription. Fragments can vary in size from as few as three amino acid residues to the full length of the intact polypeptide, but are preferably at least about 30 amino acid residues in length and more preferably at least about 60 amino acid residues in length.

Fragments may also refer to a functional fragment of a promoter region. For example, a recombinant polynucleotide capable of modulating transcription in a plant may comprise a nucleic acid sequence with similarity to, or a percentage identity to, a promoter region exemplified by a promoter sequence provided in the Sequence Listing (also see promoters listed in Example I), a fragment thereof, or a complement thereof, wherein the nucleic acid sequence, or the fragment thereof, or the complement thereof, regulates expression of a polypeptide in a plant cell.

The term "plant" includes whole plants, shoot vegetative organs/structures (for example, leaves, stems and tubers), roots, flowers and floral organs/structures (for example, bracts, sepals, petals, stamens, carpels, anthers and ovules), seed (including embryo, endosperm, and seed coat) and fruit (the mature ovary), plant tissue (for example, vascular tissue, ground tissue, and the like), pulped, pureed, ground-up, macerated or broken-up tissue, and cells (for example, guard cells, egg cells, and the like), and progeny of same. The class of the plants that can be transformed using the methods provided of the instant description is generally as broad as the class of higher and lower plants amenable to transformation techniques, including angiosperms (monocotyledonous and dicotyledonous plants), gymnosperms, ferns, horsetails, psilophytes, lycophytes, and bryophytes. These plant parts, organs, structures, cells, tissue, or progeny may contain a recombinant polynucleotide of interest, such as one that comprises a described or listed polynucleotide or one that encodes a described, listed, or an AtNAC6 clade, WRKY17 clade, AtNPR3 clade, AtMYC1 clade, AtMYB19 clade, ERF058 clade, CRF1 clade, WRKY3 clade, ZAT11 clade, MYB111 clade, SPATULA clade, and AtMYB50 clade member polypeptide.

A "control plant" as used in the present description refers to a plant cell, seed, plant component, plant tissue, plant organ or whole plant used to compare against transgenic or genetically modified plant for the purpose of identifying an enhanced phenotype in the transgenic or genetically modified plant. A control plant may in some cases be a transgenic plant line that comprises an empty vector or marker gene, but does not contain the recombinant polynucleotide of the present description that is expressed in the transgenic or genetically modified plant being evaluated. In general, a control plant is a plant of the same line or variety as the transgenic or genetically modified plant being tested. A suitable control plant would include a genetically unaltered or non-transgenic plant of the parental line used to generate a transgenic plant herein.

A "transgenic plant" refers to a plant that contains genetic material not found in a wild-type plant of the same species, variety or cultivar. The genetic material may include a transgene, an insertional mutagenesis event (such as by transposon or T-DNA insertional mutagenesis), an activation tagging sequence, a mutated sequence, a homologous recombination event or a sequence modified by chimeraplasty. Typically, the foreign genetic material has been introduced into the plant by human manipulation, but any method can be used as one of skill in the art recognizes.

A transgenic line or transgenic plant line refers to the progeny plant or plants deriving from the stable integration of heterologous genetic material into a specific location or locations within the genome of the original transformed cell.

A transgenic plant may contain an expression vector or cassette. The expression vector or cassette typically comprises a polypeptide-encoding sequence operably linked (i.e., under regulatory control of) to appropriate inducible, tissue-enhanced, tissue-specific, or constitutive regulatory sequences that allow for the controlled expression of the polypeptide. The expression vector or cassette can be introduced into a plant by transformation or by breeding after transformation of a parent plant. A plant refers to a whole plant as well as to a plant part, such as seed, fruit, leaf, or root, plant tissue, plant cells or any other plant material, e.g., a plant explant, as well as to progeny thereof, and to in vitro systems that mimic biochemical or cellular components or processes in a cell. In some other embodiments, the expression vectors or cassettes do not occur naturally. In some embodiments, the expression vectors or cassettes comprise a promoter of the present application, and a gene of interest, wherein the promoter and the gene of interest do not link to each other under natural conditions, e.g., the linkage between the promoter and the gene of interest does not exist in nature. For example, in some embodiments, the promoter and the gene of interest are derived from a same plant species, but are not linked to each other under natural conditions. In some embodiments, the promoter and the gene of interest are derived from two different species, e.g., the promoter and the gene of interest are heterologous to each other. In some embodiments, the gene of interest is derived from a different plant species, a bacteria species, a fungal species, a viral species, an algae species, or an animal species. In some embodiments, the expression vectors or cassettes comprise synthetic sequences.

"Germplasm" refers to a genetic material or a collection of genetic resources for an organism from an individual plant, a group of related individual plants (for example, a plant line, a plant variety or a plant family), or a clone derived from a plant line, plant variety, plant species, or plant culture.

A constitutive promoter is active under most environmental conditions, and in most plant parts. Regulation of protein expression in a constitutive manner refers to the control of expression of a gene and/or its encoded protein in all tissues regardless of the surrounding environment or development stage of the plant.

Alternatively, expression of the disclosed or listed polypeptides may be under the regulatory control of a promoter that is not a constitutive promoter. For example, tissue-enhanced (also referred to as tissue-preferred), tissue-specific, cell type-specific, and inducible promoters constitute non-constitutive promoters; that is, these promoters do not regulate protein expression in a constitutive manner. Tissue-enhanced or tissue-preferred promoters facilitate expression of a gene and/or its encoded protein in specific tissue(s) and generally, although perhaps not completely, do not express the gene and/or protein in all other tissues of the plant, or do so to a much lesser extent. Promoters under developmental control include promoters that preferentially initiate transcription in certain tissues, such as xylem, leaves, roots, or seeds. Such promoters are examples of tissue-enhanced or tissue-preferred promoters (see U.S. Pat. No. 7,365,186). Tissue-specific promoters generally confine transgene expression to a single plant part, tissue or cell-type, although many such promoters are not perfectly restricted in their expression and their regulatory control is more properly described as being "tissue-enhanced" or "tissue-preferred". Tissue-enhanced promoters primarily regulate transgene expression in a limited number of plant parts, tissues or cell-types and cause the expression of proteins to be overwhelming restricted to a few particular tissues, plant parts, or cell types. An example of a tissue-enhanced promoter is a "photosynthetic tissue-enhanced promoter", for which the promoter preferentially regulates gene or protein expression in photosynthetic tissues (e.g., leaves, cotyledons, stems, etc.). Tissue-enhanced promoters can be found upstream and operatively linked to DNA sequences normally transcribed in higher levels in certain plant tissues or specifically in certain plant tissues, respectively. "Cell-enhanced", "tissue-enhanced", or "tissue-specific" regulation thus refer to the control of gene or protein expression, for example, by a promoter that drives expression that is not necessarily totally restricted to a single type of cell or tissue, but where expression is elevated in particular cells or tissues to a greater extent than in other cells or tissues within the organism, and in the case of tissue-specific regulation, in a manner that is primarily elevated in a specific tissue. Tissue-enhanced or preferred promoters have been described in, for example, U.S. Pat. No. 7,365,186, or U.S. Pat. No. 7,619, 133.

Another example of a promoter that is not a constitutive promoter is a "condition-enhanced" promoter, the latter term referring to a promoter that activates a gene in response to a particular environmental stimulus. This may include, for example, an abiotic stress, infection caused by a pathogen, light treatment, etc., and a condition-enhanced promoter drives expression in a unique pattern which may include expression in specific cell and/or tissue types within the organism (as opposed to a constitutive expression pattern in all cell types of an organism at all times).

"Wild type" or "wild-type", as used herein, refers to a plant cell, seed, plant component, plant tissue, plant organ or whole plant that has not been genetically modified or treated in an experimental sense. Wild-type cells, seed, components, tissue, organs or whole plants may be used as controls to compare levels of expression and the extent and nature of trait modification with cells, tissue or plants of the same species in which a polypeptide's expression is altered, e.g., in that it has been knocked out, overexpressed, or ectopically expressed.

When two or more plants have "similar morphologies", "substantially similar morphologies", "a morphology that is substantially similar", or are "morphologically similar", the plants have comparable forms or appearances, including analogous features such as overall dimensions, height, width, mass, root mass, shape, glossiness, color, stem diameter, leaf size, leaf dimension, leaf density, internode distance, branching, root branching, number and form of inflorescences, and other macroscopic characteristics at a particular stage of growth. It may be difficult to distinguish two plants that are genotypically distinct but morphologically similar based on morphological characteristics alone. If the plants are morphologically similar at all stages of growth, they are also "developmentally similar".

With regard to gene knockouts as used herein, the term "knockout" (KO) refers to a plant or plant cell having a disruption in at least one gene in the plant or cell, where the disruption results in a reduced expression or activity of the polypeptide encoded by that gene compared to a control cell. The knockout can be the result of, for example, genomic disruptions, including transposons, tilling, and homologous recombination, antisense constructs, sense constructs, RNA silencing constructs, or RNA interference. A T-DNA insertion within a gene is an example of a genotypic alteration that may abolish expression of that gene.

"Ectopic expression" or "altered expression" in reference to a polynucleotide indicates that the pattern of expression in, e.g., a transgenic plant or plant tissue, is different from the expression pattern in a wild-type plant or a reference plant of the same species. The pattern of expression may also be compared with a reference expression pattern in a wild-type plant of the same species. For example, the polynucleotide or polypeptide is expressed in a cell or tissue type other than a cell or tissue type in which the sequence is expressed in the wild-type plant, or by expression at a time other than at the time the sequence is expressed in the wild-type plant, or by a response to different inducible agents, such as hormones or environmental signals, or at different expression levels (either higher or lower) compared with those found in a wild-type plant. The term also refers to altered expression patterns that are produced by lowering the levels of expression to below the detection level or completely abolishing expression. The resulting expression pattern can be transient or stable, constitutive or inducible. In reference to a polypeptide, the term "ectopic expression or altered expression" further may relate to altered activity levels resulting from the interactions of the polypeptides with exogenous or endogenous modulators or from interactions with factors or as a result of the chemical modification of the polypeptides.

The term "overexpression" as used herein refers to a greater expression level of a gene in a plant, plant cell or plant tissue, compared to expression of that gene in a wild-type plant, cell or tissue, at any developmental or temporal stage. Overexpression can occur when, for example, the genes encoding one or more polypeptides are under the control of a strong promoter (e.g., the cauliflower mosaic virus 35S transcription initiation region). Overexpression may also be achieved by placing a gene of interest under the control of an inducible or tissue specific promoter, or may be achieved through integration of transposons or engineered T-DNA molecules into regulatory regions of a target gene. Other means for inducing overexpression may include making targeted changes in a gene's native promoter, e.g. through elimination of negative regulatory sequences or engineering positive regulatory sequences, though the use of targeted nuclease activity (such as zinc finger nucleases or TAL effector nucleases) for genome editing. Elimination of micro-RNA binding sites in a gene's transcript may also result in overexpression of that gene. Additionally, a gene may be overexpressed by creating an artificial transcriptional activator targeted to bind specifically to its promoter sequences, comprising an engineered sequence-specific DNA binding domain such as a zinc finger protein or TAL effector protein fused to a transcriptional activation domain. Thus, overexpression may occur throughout a plant, in specific tissues of the plant, or in the presence or absence of particular environmental signals, depending on the promoter or overexpression approach used.

Overexpression may take place in plant cells normally lacking expression of polypeptides functionally equivalent or identical to the present polypeptides. Overexpression may also occur in plant cells where endogenous expression of the present polypeptides or functionally equivalent molecules normally occurs, but such normal expression is at a lower level. Overexpression thus results in a greater than normal production, or "overproduction" of the polypeptide in the plant, cell or tissue.

"Photosynthetic resource-use efficiency" is defined as the rate of photosynthesis achieved per unit use of a given resource. Consequently, increases in photosynthesis relative to the use of a given resource will improve photosynthetic resource-use efficiency. Photosynthesis is constrained by the availability of various resources, including light, water and nitrogen. Improving the efficiency with which photosynthesis makes use of light, water and nitrogen is a means for increasing plant productivity, crop growth, and yield. For the purposes of comparing a plant of interest to a reference or control plant, the ratio of photosynthesis to use of a given resource is often determined for a fixed unit of leaf area. Examples of increased photosynthetic resource-use efficiency would be an increase in the ratio of the rate of photosynthesis for a given leaf relative to, for example, the rate of transpiration from the same leaf area, nitrogen or chlorophyll invested in that leaf area, or light absorbed by that same leaf area. Increased photosynthetic resource use efficiency may result from increased photosynthetic rate, photosynthetic capacity, a decrease in leaf chlorophyll content, a decrease in percentage of nitrogen in leaf dry weight, increased transpiration efficiency, an increase in resistance to water vapor diffusion exerted by leaf stomata, an increased rate of relaxation of photoprotective reactions operating in the light harvesting antennae, a decrease in the ratio of the carbon isotope $^{12}C$ to $^{13}C$ in above-ground biomass, and/or an increase in the total dry weight of above-ground plant material.

"Photosynthetic rate" refers to the rate of photosynthesis achieved by a leaf, and is typically expressed relative to a unit of leaf area. The photosynthetic rate at any given time results from the photosynthetic capacity of the leaf (see below) and the biotic or abiotic environmental constraints prevailing at that time.

"Photosynthetic capacity" refers to the capacity for photosynthesis per unit leaf area and is set by the leafs investment in the components of the photosynthetic apparatus. Key components, among many, would be the pigments and proteins required to regulate light absorption and transduction of light energy to the photosynthetic reaction centers, and the enzymes required to operate the C3 and C4 dark reactions of photosynthesis. Increasing photosynthetic capacity is seen as an important means of increasing leaf and crop-canopy photosynthesis, and crop yield.

"Rubisco (ribulose-1,5-bisphosphate carboxylase oxygenase) activity" refers to the activation state of Rubisco, the most abundant protein in the chloroplast and a key limitation to C3 photosynthesis. Increasing Rubisco activity by: increasing the amount of Rubisco in the chloroplast; impacting any combination of specific reactions that regulate Rubisco activity; or increasing the concentration of $CO_2$ in the chloroplast, is seen as an important means to improving C3 leaf and crop-canopy photosynthesis and crop yield.

The "capacity for RuBP (ribulose-1,5-bisphosphate) regeneration" refers to the rate at which RuBP, a key photosynthetic substrate is regenerated in the Calvin cycle. Increasing the capacity for RuBP regeneration by increasing the activity of enzymes in the regenerative phase of the Calvin cycle is seen as an important means to improving C3 leaf and crop-canopy photosynthesis and crop yield that will become progressively more important as atmospheric $CO_2$ concentrations continue to rise.

"Leaf chlorophyll content" refers to the chlorophyll content of the leaf expressed either per unit leaf area or unit weight. Sun leaves in the upper part of crop canopies are thought to have higher leaf chlorophyll content than is required for photosynthesis. The consequence is that these leaves: invest more nitrogen in chlorophyll than is required for photosynthesis; are prone to photodamage associated with absorbing more light energy than can be dissipated via photosynthesis; and impair the transmission of light into the leaf and lower canopy where photosynthesis is light limited. Consequently, decreasing leaf chlorophyll content of upper canopy leaves is considered an effective means to improving photosynthetic resource-use efficiency.

"Non-photochemical quenching" is a term that covers photoprotective processes that dissipate absorbed light energy as heat from the light-harvesting antenna of photosystem II. Non-photochemical quenching is a key regulator of the efficiency with which electron transport is initiated by PSII and the efficiency of photosynthesis at low light. Decreasing the level of non-photochemical quenching, or increasing the speed with which it relaxes is expected to confer cumulative gains in photosynthesis every time the light intensity to which the canopy is exposed transitions from high to low, and is considered a means to improving canopy photosynthesis when integrated over a growing season.

"Nitrogen limitation" or "nitrogen-limiting" refers to nitrogen levels that act as net limitations on primary production in terrestrial or aquatic biomes. Much of terrestrial growth, including much of crop growth, is limited by the availability of nitrogen, which can be alleviated by nitrogen input through deposition or fertilization.

"Water use efficiency", or WUE, measured as the biomass produced per unit transpiration, describes the relationship between water use and crop production. The basic physiological definition of WUE equates to the ratio of photosynthesis (A) to transpiration (T), also referred to as transpiration efficiency (Karaba et al. 2007, supra; Morison et al., 2008, supra).

"Stomatal conductance" refers to a measurement of the limitation that the stomatal pore imposes on $CO_2$ diffusion into, and $H_2O$ diffusion out of, the leaf. Decreasing stomatal conductance will decrease water loss from the leaf and crop canopy via transpiration. This will conserve soil water, delay the onset and reduce the severity of drought effects on canopy photosynthesis and other physiology. Decreasing stomatal conductance will also decrease photosynthesis. However, the magnitude of the decrease in photosynthesis will typically be less than the decrease in transpiration, and transpiration efficiency will increase as a result. Conversely, increasing stomatal conductance can increase the diffusion of $CO_2$ into the leaf and increase photosynthesis in a C3 leaf. Typically, transpiration will increase to a greater extent than photosynthesis, and transpiration efficiency will therefore decrease.

"Yield" or "plant yield" refers to increased plant growth, increased crop growth, increased biomass, and/or increased plant product production (including grain), and is dependent to some extent on temperature, plant size, organ size, planting density, light, water and nutrient availability, and how the plant copes with various stresses, such as through temperature acclimation and water or nutrient use efficiency. For grain crops, yield generally refers to an amount of grain produced or harvested per unit of land area, such as bushels or tons per acre or tonnes per hectare. Increased or improved yield may be measured as increased seed yield, increased plant product yield (plant products include, for example, plant tissue, including ground or otherwise broken-up plant tissue, and products derived from one or more types of plant tissue), or increased vegetative yield.

DESCRIPTION OF THE SPECIFIC EMBODIMENTS

Regulatory Polypeptides Modify Expression of Endogenous Genes

A regulatory polypeptide may include, but is not limited to, any polypeptide that can activate or repress transcription of a single gene or a number of genes. As one of ordinary skill in the art recognizes, regulatory polypeptides can be identified by the presence of a region or domain of structural similarity or identity to a specific consensus sequence or the presence of a specific consensus DNA-binding motif (see, for example, Riechmann et al., 2000a. supra). The plant regulatory polypeptides of the instant description belong to the MYB-(R1)R2R3 family (Shore and Sharrocks, 1995. Eur. J. Biochem. 229:1-13; Ng and Yanofsky, 2001. Nat. Rev. Genet. 2:186-195; Alvarez-Buylla et al., 2000. Proc.

Natl. Acad. Sci. USA. 97:5328-5333), AP2 family (Shore and Sharrocks, 1995. Eur. J. Biochem. 229:1-13; Ng and Yanofsky, 2001. Nat. Rev. Genet. 2:186-195; Alvarez-Buylla et al., 2000. Proc. Natl. Acad. Sci. USA. 97:5328-5333), HLH/MYC family (Toledo-Ortiz et al. (2003) The Plant Cell (15) 1749-1770; Heim et al. (2003) Mol. Biol. Evol. 20(5): 735-747; Weigel and Nilsson, 1995. Nature 377: 495-500; Goff, 1992. Genes Dev. 6: 864-875; Murre, 1989. Cell 58: 537-544), MYB-(R1)R2R3 family (Myb Domain Protein 111, NCBI Reference Sequence: NP_199744.1; Stracke et al., 2007. Plant J. 50:660-677; Dai et al. 2007. Plant Physiol. 143: 1739-1751; Gabrielsen et al. 1991. Science 253:1140-1143), AKR family (Michaely et al. (1992) Trends Cell Biol. 2:127-129; Bork (1993) Proteins 17:363-374; Cao et al. (1997) Cell 88:57-63), WRKY family (Ishiguro and Nakamura (1994) Mol. Gen. Genet. 244:563-571; Eulgem et al. (2000) Trends Plant Sci. 5:199-206; Ülker and Somssich IE (2004) Curr. Opin. Plant Biol. 7:491-498; Zhang and Wang (2005) BMC Evol. Biol. 5:1; Lai et al., (2008) BMC Plant Biol. 8:68; Pandey and Somssich (2009) Plant Physiol. 150:1648-1655), NAC family (Olsen et al. 2005. Trends Plant Sci. 10:79-87; Ooka et al. 2003. DNA Res. 10:239-47), Z-C2H2 family (Berg, 1988. Proc. Natl. Acad. Sci. USA. 85: 99-102; Meissner and Michael, 1997. Plant Mol. Biol. 33: 615-624; Thiesen and Bach, 1993. Ann. NY Acad. Sci. 684: 246-249) family and are putative regulatory polypeptides.

Generally, regulatory polypeptides control the manner in which information encoded by genes is used to produce gene products and control various pathways, and may be involved in diverse processes including, but not limited to, cell differentiation, proliferation, morphogenesis, and the regulation of growth or environmental responses. Accordingly, one skilled in the art would recognize that by expressing the present sequences in a plant, one may change the expression of autologous genes or induce the expression of introduced genes. By affecting the expression of similar autologous sequences in a plant that have the biological activity of the present sequences, or by introducing the present sequences into a plant, one may alter a plant's phenotype to one with improved traits related to photosynthetic resource use efficiency. The sequences of the instant description may also be used to transform a plant and introduce desirable traits not found in the wild-type cultivar or strain. Plants may then be selected for those that produce the most desirable degree of over- or under-expression of target genes of interest and coincident trait improvement.

The sequences of the present description may be from any species, particularly plant species, in a naturally occurring form or from any source whether natural, synthetic, semi-synthetic or recombinant. The sequences of the instant description may also include fragments of the present amino acid sequences. Where "amino acid sequence" is recited to refer to an amino acid sequence of a naturally occurring protein molecule, "amino acid sequence" and like terms are not meant to limit the amino acid sequence to the complete native amino acid sequence associated with the recited protein molecule.

In addition to methods for modifying a plant phenotype by employing one or more polynucleotides and polypeptides of the instant description described herein, the polynucleotides and polypeptides of the instant description have a variety of additional uses. These uses include their use in the recombinant production (i.e., expression) of proteins; as regulators of plant gene expression, as diagnostic probes for the presence of complementary or partially complementary nucleic acids (including for detection of natural coding nucleic acids); as substrates for further reactions, e.g., mutation reactions, PCR reactions, or the like; as substrates for cloning e.g., including digestion or ligation reactions; and for identifying exogenous or endogenous modulators of the regulatory polypeptides. The polynucleotide can be, e.g., genomic DNA or RNA, a transcript (such as an mRNA), a cDNA, a PCR product, a cloned DNA, a synthetic DNA or RNA, or the like. The polynucleotide can comprise a sequence in either sense or antisense orientations.

Expression of genes that encode polypeptides that modify expression of endogenous genes, polynucleotides, and proteins are well known in the art. In addition, transgenic plants comprising polynucleotides encoding regulatory polypeptides may also modify expression of endogenous genes, polynucleotides, and proteins. Examples include Peng et al., 1997. Genes Development 11: 3194-3205, and Peng et al., 1999. Nature 400: 256-261. In addition, many others have demonstrated that an Arabidopsis regulatory polypeptide expressed in an exogenous plant species elicits the same or very similar phenotypic response. See, for example, Fu et al., 2001. Plant Cell 13: 1791-1802; Nandi et al., 2000. Curr. Biol. 10: 215-218; Coupland, 1995. Nature 377: 482-483; and Weigel and Nilsson, 1995. Nature 377: 482-500.

In another example, Mandel et al., 1992b. Cell 71-133-143, and Suzuki et al., 2001. Plant J. 28: 409-418, teach that a transcription factor expressed in another plant species elicits the same or very similar phenotypic response of the endogenous sequence, as often predicted in earlier studies of Arabidopsis transcription factors in Arabidopsis (see Mandel et al., 1992a. Nature 360: 273-277; Suzuki et al., 2001. supra). Other examples include Müller et al., 2001. Plant J. 28: 169-179; Kim et al., 2001. Plant J. 25: 247-259; Kyozuka and Shimamoto, 2002. Plant Cell Physiol. 43: 130-135; Boss and Thomas, 2002. Nature, 416: 847-850; He et al., 2000. Transgenic Res. 9: 223-227; and Robson et al., 2001. Plant J. 28: 619-631.

In yet another example, Gilmour et al., 1998. Plant J. 16: 433-442 teach an Arabidopsis AP2 transcription factor, CBF1, which, when overexpressed in transgenic plants, increases plant freezing tolerance. Jaglo et al., 2001. Plant Physiol. 127: 910-917, further identified sequences in Brassica napus which encode CBF-like genes and that transcripts for these genes accumulated rapidly in response to low temperature. Transcripts encoding CBF proteins were also found to accumulate rapidly in response to low temperature in wheat, as well as in tomato. An alignment of the CBF proteins from Arabidopsis, B. napus, wheat, rye, and tomato revealed the presence of conserved consecutive amino acid residues which bracket the AP2/EREBP DNA binding domains of the proteins and distinguish them from other members of the AP2/EREBP protein family (Jaglo et al., 2001. supra).

Regulatory polypeptides mediate cellular responses and control traits through altered expression of genes containing cis-acting nucleotide sequences that are targets of the introduced regulatory polypeptide. It is well appreciated in the art that the effect of a regulatory polypeptide on cellular responses or a cellular trait is determined by the particular genes whose expression is either directly or indirectly (e.g., by a cascade of regulatory polypeptide binding events and transcriptional changes) altered by regulatory polypeptide binding. In a global analysis of transcription comparing a standard condition with one in which a regulatory polypeptide is overexpressed, the resulting transcript profile associated with regulatory polypeptide overexpression is related to the trait or cellular process controlled by that regulatory polypeptide. For example, the PAP2 gene and other genes in the Myb family have been shown to control anthocyanin biosynthesis through regulation of the expression of genes known to be involved in the anthocyanin biosynthetic pathway (Bruce et al., 2000. *Plant Cell* 12: 65-79; and Borevitz et al., 2000. *Plant Cell* 12: 2383-2393). Further, global transcript profiles have been used successfully as diagnostic tools for specific cellular states (e.g., cancerous vs. noncancerous; Bhattacharjee et al., 2001. *Proc. Natl. Acad. Sci. USA* 98: 13790-13795; and Xu et al., 2001. *Proc. Natl. Acad. Sci. USA* 98: 15089-15094). Consequently, it is evident to one skilled in the art that similarity of transcript profile upon overexpression of different regulatory polypeptides would indicate similarity of regulatory polypeptide function.

Polypeptides and Polynucleotides of the Present Description.

The present description includes putative regulatory polypeptides, and isolated or recombinant polynucleotides encoding the polypeptides, or novel sequence variant polypeptides or polynucleotides encoding novel variants of polypeptides derived from the specific sequences provided in the Sequence Listing; the recombinant polynucleotides of the instant description may be incorporated in expression vectors for the purpose of producing transformed plants.

Because of their relatedness at the nucleotide level, the claimed sequences will typically share at least about 30% nucleotide sequence identity, or at least 35% identity, at least 40% nucleotide sequence identity, at least 45% identity, at least 50%, at least 51%, at least 52%, at least 53%, at least 54%, at least 55%, at least 56%, at least 57%, at least 58%, at least 59%, at least 60%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% or at least 96%, at least 97%, at least 98%, at least 99%, or about 100% sequence identity to one or more of the listed full-length sequences, or to a listed sequence but excluding or outside of the region(s) encoding a known consensus sequence or consensus DNA-binding site, or outside of the region(s) encoding one or all conserved domains. The degeneracy of the genetic code enables major variations in the nucleotide sequence of a polynucleotide while maintaining the amino acid sequence of the encoded protein.

Because of their relatedness at the protein level, the claimed nucleotide sequences will typically encode a polypeptide that is at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% identical, in its amino acid sequence to the entire length of any of SEQ ID NO: 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433; or 1507, 1509, 1511, 1513, 1515, 1517, 1519, 1521, 1523, 1525, 1527, 1529, 1531; or 864, 866, 868, 870, 872, 874, 876, 878, 880, 882, 884, 886, 888, 890, 892, 894, 896, 898, 900, 902, 904, 906, 908, 910, 912, 914, 916, 918, 920, 922; or 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072; or: 2, 4, 6, 8, 10, 12, 14, 16, 18, 20, 22, 24, 26, 28, 30, 32, 34; or 490, 492, 494, 496, 498, 500, 502, 504, 506, 508, 510, 512, 514, 516, 518, 520, 522, 524, 526, 528, 530, 532, 534, 536, 538, 540, 542, 544, 546, 548; or 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395; or 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226; or 1591, 1593, 1595, 1597, 1599, 1601, 1603, 1605, 1607, 1609, 1611, 1613, 1615, 1617; or 735, 737, 739, 741, 743, 745, 747, 749, 751, 753, 755, 757, 759, 761, 763, 765, 767, 769, 771, 773, 775, 777, 779, 781, 783; or 625, 627, 629, 631, 633, 635, 637, 639, 641, 643, 645, 647, 649, 651, 653, 655, 657, 659, 661, 663, 665; or 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, or 209.

Also provided are methods for modifying yield from a plant by modifying the mass, size or number of plant organs or seed of a plant by controlling a number of cellular processes, and for increasing a plant's photosynthetic resource use efficiency. These methods are based on the ability to alter the expression of critical regulatory molecules that may be conserved between diverse plant species. Related conserved regulatory molecules may be originally discovered in a model system such as *Arabidopsis* and homologous, functional molecules then discovered in other plant species. The latter may then be used to confer increased yield or photosynthetic resource use efficiency in diverse plant species.

Sequences in the Sequence Listing, derived from diverse plant species, may be ectopically expressed in overexpressor plants. The changes in the characteristic(s) or trait(s) of the plants may then be observed and found to confer increased yield and/or increased photosynthetic resource use efficiency. Therefore, the polynucleotides and polypeptides can be used to improve desirable characteristics of plants.

The polynucleotides of the instant description are also ectopically expressed in overexpressor plant cells and the changes in the expression levels of a number of genes, polynucleotides, and/or proteins of the plant cells observed. Therefore, the polynucleotides and polypeptides can be used to change expression levels of genes, polynucleotides, and/or proteins of plants or plant cells.

The data presented herein represent the results obtained in experiments with polynucleotides and polypeptides that may be expressed in plants for the purpose of increasing yield that arises from improved photosynthetic resource use efficiency.

Variants of the Disclosed Sequences.

Also within the scope of the instant description is a variant of a nucleic acid listed in the Sequence Listing, that is, one having a sequence that differs from the one of the polynucleotide sequences in the Sequence Listing, or a complementary sequence, that encodes a functionally equivalent polypeptide (i.e., a polypeptide having some degree of equivalent or similar biological activity) but differs in sequence from the sequence in the Sequence Listing, due to degeneracy in the genetic code. Included within this definition are polymorphisms that may or may not be readily detectable using a particular oligonucleotide probe of the polynucleotide encoding polypeptide, and improper or unexpected hybridization to allelic variants, with a locus other than the normal chromosomal locus for the polynucleotide sequence encoding polypeptide.

Differences between presently disclosed polypeptides and polypeptide variants are limited so that the sequences of the former and the latter are closely similar overall and, in many regions, identical. Presently disclosed polypeptide sequences and similar polypeptide variants may differ in amino acid sequence by one or more substitutions, additions, deletions, fusions and truncations, which may be present in any combination. These differences may produce silent changes and result in a functionally equivalent polypeptides. Thus, it will be readily appreciated by those of skill in the art, that any of a variety of polynucleotide sequences is capable of encoding the polypeptides and homolog polypeptides of the instant description. A polypeptide sequence variant may have "conservative" changes, wherein a substituted amino acid has similar structural or chemical properties.

Conservative substitutions include substitutions in which at least one residue in the amino acid sequence has been removed and a different residue inserted in its place. Such substitutions generally are made in accordance with the Table 1 when it is desired to maintain the activity of the protein. Table 1 shows amino acids which can be substituted for an amino acid in a protein and which are typically regarded as conservative substitutions.

TABLE 1

Possible conservative amino acid substitutions

| Amino Acid Residue | Conservative substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu; Val |
| Leu | Ile; Val |
| Lys | Arg; Gln |
| Met | Leu; Ile |
| Phe | Met; Leu; Tyr |
| Pro | Gly |
| Ser | Thr; Gly |
| Thr | Ser; Val |
| Trp | Tyr |
| Tyr | Trp; Phe |
| Val | Ile; Leu |

The polypeptides provided in the Sequence Listing have a novel activity, such as, for example, regulatory activity. Although all conservative amino acid substitutions (for example, one basic amino acid substituted for another basic amino acid) in a polypeptide will not necessarily result in the polypeptide retaining its activity, it is expected that many of these conservative mutations would result in the polypeptide retaining its activity. Most mutations, conservative or non-conservative, made to a protein but outside of a conserved domain required for function and protein activity will not affect the activity of the protein to any great extent.

Deliberate amino acid substitutions may thus be made on the basis of similarity in polarity, charge, solubility, hydrophobicity, hydrophilicity, and/or the amphipathic nature of the residues, as long as a significant amount of the functional or biological activity of the polypeptide is retained. For example, negatively charged amino acids may include aspartic acid and glutamic acid, positively charged amino acids may include lysine and arginine, and amino acids with uncharged polar head groups having similar hydrophilicity values may include leucine, isoleucine, and valine; glycine and alanine; asparagine and glutamine; serine and threonine; and phenylalanine and tyrosine. More rarely, a variant may have "non-conservative" changes, e.g., replacement of a glycine with a tryptophan. Similar minor variations may also include amino acid deletions or insertions, or both. Related polypeptides may comprise, for example, additions and/or deletions of one or more N-linked or O-linked glycosylation sites, or an addition and/or a deletion of one or more cysteine residues. Guidance in determining which and how many amino acid residues may be substituted, inserted or deleted without abolishing functional or biological activity may be found using computer programs well known in the art, for example, DNASTAR software (see U.S. Pat. No. 5,840,544).

Conserved Domains.

Conserved domains are recurring functional and/or structural units of a protein sequence within a protein family (for example, a family of regulatory proteins), and distinct conserved domains have been used as building blocks in molecular evolution and recombined in various arrangements to make proteins of different protein families with different functions. Conserved domains often correspond to the 3-dimensional domains of proteins and contain conserved sequence patterns or motifs, which allow for their detection in polypeptide sequences with, for example, the use of a Conserved Domain Database (for example, at www.ncbi.nlm.nih.gov/cdd). The National Center for Biotechnology Information Conserved Domain Database defines conserved domains as recurring units in molecular evolution, the extents of which can be determined by sequence and structure analysis. Conserved domains contain conserved sequence patterns or motifs, which allow for their detection in polypeptide sequences (Conserved Domain Database; www.ncbi.nlm.nih.gov/Structure/cdd/cdd.shtml). A "conserved domain" or "conserved region" as used herein refers to a region in heterologous polynucleotide or polypeptide sequences where there is a relatively high degree of sequence identity between the distinct sequences. A 'NAM domain' is an example of a conserved domain.

Conserved domains may also be identified as regions or domains of identity to a specific consensus sequence (see, for example, Riechmann et al., 2000a. Science 290, 2105-2110; Riechmann et al., 2000b. Curr Opin Plant Biol 3: 423-434). Thus, by using alignment methods well known in the art, the conserved domains of the plant polypeptides, for example, for the NAM domain proteins may be determined. The polypeptides of Table 17 have conserved domains specifically indicated by amino acid coordinate start and stop sites. A comparison of the regions of these polypeptides allows one of skill in the art (see, for example, Reeves and Nissen, 1990. J. Biol. Chem. 265, 8573-8582; Reeves and Nissen, 1995. Prog. Cell Cycle Res. 1: 339-349) to identify domains or conserved domains for any of the polypeptides listed or referred to in this disclosure.

Conserved domain models are generally identified with multiple sequence alignments of related proteins spanning a variety of organisms (for example, exemplary conserved domains of the disclosed sequences can be found in Tables 2-21) and the Sequence Listing. These alignments reveal sequence regions containing the same, or similar, patterns of amino acids. Multiple sequence alignments, three-dimensional structure and three-dimensional structure superposition of conserved domains can be used to infer sequence, structure, and functional relationships (Conserved Domain Database, supra). Since the presence of a particular conserved domain within a polypeptide is highly correlated with an evolutionarily conserved function, a conserved domain database may be used to identify the amino acids in a protein sequence that are putatively involved in functions such as binding or catalysis, as mapped from conserved domain annotations to the query sequence. For example, the presence in a protein of a NAM domain that is structurally and phylogenetically similar to one or more domains shown in Table 17 would be a strong indicator of a related function in plants (e.g., the function of regulating and/or improving photosynthetic resource use efficiency, yield, size, biomass, and/or vigor; i.e., a polypeptide with such a domain is expected to confer altered photosynthetic resource use efficiency, yield, size, biomass, and/or vigor when its expression level is altered). Sequences herein referred to as functionally-related and/or closely-related to the sequences or domains listed in Tables 2 through 21 including polypeptides that are closely related to the polypeptides of the instant description, may have conserved domains that share at least 15 amino acid residues in length and at least 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% amino acid identity to the sequences provided in the Sequence Listing or in Tables 2 through 21, or at least 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% sequence identity to a listed or disclosed consensus sequence, and have similar functions in that the polypeptides of the instant description. Said polypeptides may, when their expression level is altered by suppressing their expression, knocking out their expression, or increasing their expression, confer at least one regulatory activity selected from the group consisting of increased photosynthetic resource use efficiency, greater yield, greater size, greater biomass, and/or greater vigor as compared to a control plant. Methods using manual alignment of sequences similar or homologous to one or more polynucleotide sequences or one or more polypeptides encoded by the polynucleotide sequences may be used to identify regions of similarity and the NAM domain, Plant Zinc Cluster domain, BTB domain, bHLH-MYC domain, Myb DNA binding domain, WRKY DNA-binding domain, C2H2-type zinc finger (Z-C2H2) domain, AP2 domain, HLH domain, SANT domain, ANK domain, HLH domain, or ('Z-C2H2-2') domain, or other motifs. Such manual methods are well-known of those of skill in the art and can include, for example, comparisons of tertiary structure between a polypeptide sequence encoded by a polynucleotide that comprises a known function and a polypeptide sequence encoded by a polynucleotide sequence that has a function not yet determined. Such examples of tertiary structure may comprise predicted alpha helices, beta-sheets, amphipathic helices, leucine zipper motifs, zinc finger motifs, proline-rich regions, cysteine repeat motifs, and the like.

With respect to polynucleotides encoding presently disclosed polypeptides, a conserved domain refers to a subsequence within a polypeptide family the presence of which is correlated with at least one function exhibited by members of the polypeptide family, and which exhibits a high degree of sequence homology, such as at least 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% identity to a consensus sequence of a polypeptide of the Sequence Listing (e.g., any of AtNAC6 clade sequences SEQ ID NO: 1467, 1468, 1469, WRKY17 clade sequences SEQ ID NO: 1558, 1559, 1560, 1561, AtNPR3 clade sequences SEQ ID NO: 981 to 986, AtMYC1 clade sequences SEQ ID NO: 1153, 1154, AtMYB19 clade consensus sequences SEQ ID NO: 129, 130, 131, 132, ERF058 clade consensus sequences SEQ ID NO: 579, 580, 581, CRF1 clade consensus sequences SEQ ID NO: 441, 442, WRKY3 clade consensus sequences SEQ ID NO: 1299, 1300, ZAT11 clade consensus sequences SEQ ID NO: 1646, 1647, 1648, MYB111 clade consensus sequences SEQ ID NO: 834, 835, 836, SPATULA clade consensus sequence SEQ ID NO: 687, or AtMYB50 clade consensus sequences SEQ ID NO: 302, 303, 304, 305, or presented in the present Figures. Sequences that possess or encode for conserved domains that meet these criteria of percentage identity, and that have comparable biological and regulatory activity to the present polypeptide sequences, thus being members of the AtNAC6, WRKY17, AtNPR3, AtMYC1, AtMYB19, ERF058, CRF1, WRKY3, ZAT11, MYB111, SPATULA, or AtMYB50 clade polypeptides or sequences in the AtNAC6, WRKY17, AtNPR3, AtMYC1, AtMYB19, ERF058, CRF1, WRKY3, ZAT11, MYB111, SPATULA, or AtMYB50 clade, are described. Sequences having lesser degrees of identity but comparable biological activity are considered to be equivalents.

Orthologs and Paralogs.

Homologous sequences as described above can comprise orthologous or paralogous sequences. Several different methods are known by those of skill in the art for identifying and defining these functionally homologous sequences. General methods for identifying orthologs and paralogs, including phylogenetic methods, sequence similarity and hybridization methods, are described herein; an ortholog or paralog, including equivalogs, may be identified by one or more of the methods described below.

As described by Eisen, 1998. *Genome Res.* 8: 163-167, evolutionary information may be used to predict gene function. It is common for groups of genes that are homologous in sequence to have diverse, although usually related, functions. However, in many cases, the identification of homologs is not sufficient to make specific predictions because not all homologs have the same function. Thus, an initial analysis of functional relatedness based on sequence similarity alone may not provide one with a means to determine where similarity ends and functional relatedness begins. Fortunately, it is well known in the art that protein function can be classified using phylogenetic analysis of gene trees combined with the corresponding species. Functional predictions can be greatly improved by focusing on how the genes became similar in sequence (i.e., by evolutionary processes) rather than on the sequence similarity itself (Eisen, supra). In fact, many specific examples exist in which gene function has been shown to correlate well with gene phylogeny (Eisen, supra). Thus, "[t]he first step in making functional predictions is the generation of a phylogenetic tree representing the evolutionary history of the gene of interest and its homologs. Such trees are distinct from clusters and other means of characterizing sequence similarity because they are inferred by techniques that help convert patterns of similarity into evolutionary relationships . . . . After the gene tree is inferred, biologically determined functions of the various homologs are overlaid onto the tree. Finally, the structure of the tree and the relative phylogenetic positions of genes of different functions are used to trace the history of functional changes, which is then used to predict functions of [as yet] uncharacterized genes" (Eisen, supra).

Within a single plant species, gene duplication may cause two copies of a particular gene, giving rise to two or more genes with similar sequence and often similar function known as paralogs. A paralog is therefore a similar gene formed by duplication within the same species. Paralogs typically cluster together or in the same clade (a group of similar genes) when a gene family phylogeny is analyzed using programs such as CLUSTAL (Thompson et al., 1994. *Nucleic Acids Res.* 22: 4673-4680; Higgins et al., 1996. *Methods Enzymol.* 266: 383-402). Groups of similar genes can also be identified with pair-wise BLAST analysis (Feng and Doolittle, 1987. *J. Mol. Evol.* 25: 351-360). For example, a clade of very similar MADS domain transcription factors from *Arabidopsis* all share a common function in flowering time (Ratcliffe et al., 2001. *Plant Physiol.* 126: 122-132), and a group of very similar AP2 domain transcription factors from *Arabidopsis* are involved in tolerance of plants to freezing (Gilmour et al., 1998. supra). Analysis of groups of similar genes with similar function that fall within one clade can yield sub-sequences that are particular to the clade. These sub-sequences, known as consensus sequences, can not only be used to define the sequences within each clade, but define the functions of these genes; genes within a clade may contain paralogous sequences, or orthologous sequences that share the same function (see also, for example, Mount, 2001, in *Bioinformatics: Sequence and Genome Analysis*, Cold Spring Harbor Laboratory Press, Cold Spring Harbor, N.Y., p. 543).

Regulatory polypeptide gene sequences are conserved across diverse eukaryotic species lines (Goodrich et al., 1993. *Cell* 75:519-530; Lin et al., 1991. *Nature* 353:569-571; Sadowski et al., 1988. *Nature* 335: 563-564). Plants are no exception to this observation; diverse plant species possess regulatory polypeptides that have similar sequences and functions. Speciation, the production of new species from a parental species, gives rise to two or more genes with similar sequence and similar function. These genes, termed orthologs, often have an identical function within their host plants and are often interchangeable between species without losing function. Because plants have common ancestors, many genes in any plant species will have a corresponding orthologous gene in another plant species. Once a phylogenic tree for a gene family of one species has been constructed using a program such as CLUSTAL (Thompson et al., 1994. supra; Higgins et al., 1996. supra) potential orthologous sequences can be placed into the phylogenetic tree and their relationship to genes from the species of interest can be determined. Orthologous sequences can also be identified by a reciprocal BLAST strategy. Once an orthologous sequence has been identified, the function of the ortholog can be deduced from the identified function of the reference sequence.

By using a phylogenetic analysis, one skilled in the art would recognize that the ability to deduce similar functions conferred by closely-related polypeptides is predictable. This predictability has been confirmed by our own many studies in which we have found that a wide variety of polypeptides have orthologous or closely-related homologous sequences that function as does the first, closely-related reference sequence. For example, distinct regulatory polypeptides, including:

(i) AP2 family *Arabidopsis* G47 (found in U.S. Pat. No. 7,135,616), a phylogenetically-related sequence from soybean, and two phylogenetically-related homologs from rice all can confer greater tolerance to drought, hyperosmotic stress, or delayed flowering as compared to control plants;

(ii) CAAT family *Arabidopsis* G481 (found in PCT patent publication no. WO2004076638), and numerous phylogenetically-related sequences from eudicots and monocots can confer greater tolerance to drought-related stress as compared to control plants;

(iii) Myb-related *Arabidopsis* G682 (found in U.S. Pat. Nos. 7,223,904 and 7,193,129) and numerous phylogenetically-related sequences from eudicots and monocots can confer greater tolerance to heat, drought-related stress, cold, and salt as compared to control plants;

(iv) WRKY family *Arabidopsis* G1274 (found in U.S. Pat. No. 7,196,245) and numerous closely-related sequences from eudicots and monocots have been shown to confer increased water deprivation tolerance, and (v) AT-hook family soy sequence G3456 (found in U.S. patent publication no. 20040128712A1) and numerous phylogenetically-related sequences from eudicots and monocots, increased biomass compared to control plants when these sequences are overexpressed in plants.

The polypeptides sequences belong to distinct clades of polypeptides that include members from diverse species. In each case, most or all of the clade member sequences derived from both eudicots and monocots have been shown to confer increased yield or tolerance to one or more abiotic stresses when the sequences were overexpressed. These studies each demonstrate that evolutionarily conserved genes from diverse species are likely to function similarly (i.e., by regulating similar target sequences and controlling the same traits), and that polynucleotides from one species may be transformed into closely-related or distantly-related plant species to confer or improve traits.

Orthologs and paralogs of presently disclosed polypeptides may be cloned using compositions provided by the present description according to methods well known in the art. cDNAs can be cloned using mRNA from a plant cell or tissue that expresses one of the present sequences. Appropriate mRNA sources may be identified by interrogating Northern blots with probes designed from the present sequences, after which a library is prepared from the mRNA obtained from a positive cell or tissue. Polypeptide-encoding cDNA is then isolated using, for example, PCR, using primers designed from a presently disclosed gene sequence, or by probing with a partial or complete cDNA or with one or more sets of degenerate probes based on the disclosed sequences. The cDNA library may be used to transform plant cells. Expression of the cDNAs of interest is detected using, for example, microarrays, Northern blots, quantitative PCR, or any other technique for monitoring changes in expression. Genomic clones may be isolated using similar techniques to those.

Examples of orthologs of the *Arabidopsis* polypeptide sequences and their functionally similar orthologs are listed in Tables 2 through 21 and the Sequence Listing. In addition to the sequences in Tables 2 through 21 and the Sequence Listing, the claimed nucleotide sequences are phylogenetically and structurally similar to sequences listed in the Sequence Listing and can function in a plant by increasing photosynthetic resource use efficiency and/or and increasing yield, vigor, or biomass when ectopically expressed, or overexpressed, in a plant. Since a significant number of these sequences are phylogenetically and sequentially related to each other and may be shown to increase yield from a plant and/or photosynthetic resource use efficiency, one skilled in the art would predict that other similar, phylogenetically related sequences falling within the present clades of polypeptides, including AtNAC6, WRKY17, AtNPR3, AtMYC1, AtMYB19, ERF058, CRF1, WRKY3, ZAT11, MYB111, SPATULA, and AtMYB50 clade polypeptide sequences, would also perform similar functions when ectopically expressed.

Background Information for the AtNAC6 clade, WRKY17 clade, AtNPR3 clade, AtMYC1 clade, AtMYB19 clade, ERF058 clade, CRF1 clade, WRKY3 clade, ZAT11 clade, MYB111 clade, SPATULA clade, and AtMYB50 clades. A number of phylogenetically-related sequences have been found in other plant species. Tables 2 through 21 list a number of AtNAC6, WRKY17, AtNPR3, AtMYC1, AtMYB19, ERF058, CRF1, WRKY3, ZAT11, MYB111, SPATULA, or AtMYB50 clade sequences from diverse species. The tables include the SEQ ID NO: (Column 1), the species from which the sequence was derived and the Gene Identifier ("GID"; Column 2), the percent identity of the polypeptide in Column 1 to the full length AtNAC6, WRKY17, AtNPR3, AtMYC1, AtMYB19, ERF058, CRF1, WRKY3, ZAT11, MYB111, SPATULA, or AtMYB50 polypeptide, SEQ ID NO: 1369, 1507, 864, 1016, 2, 490, 307, 1156, 1591, 735, 625, or 135, respectively, as determined by a BLASTp analysis, for example, with a wordlength (W) of 3, an expectation (E) of 10, and the BLOSUM62 scoring matrix (Henikoff and Henikoff, 1989. *Proc. Natl. Acad. Sci. USA* 89:10915; Henikoff and Henikoff, 1991. *Nucleic Acids Res.* 19: 6565-6572) (Column 3), the amino acid residue coordinates for the listed conserved domains in amino acid coordinates beginning at the N-terminus, of each of the sequences (Column 4), the conserved domain sequences of the respective polypeptides (Column 5); the SEQ ID NO: of each of the conserved domain (Column 6), and the percentage identity of the conserved domain in Column 5 to the conserved domain of the *Arabidopsis* AtNAC6, WRKY17, AtNPR3, AtMYC1, AtMYB19, ERF058, CRF1, WRKY3, ZAT11, MYB111, SPATULA, or AtMYB50 sequence, SEQ ID NO: 1369, 1507, 864, 1016, 2, 490, 307, 1156, 1591, 735, 625, or 135 (as determined by a BLASTp analysis, wordlength (W) of 3, an expectation (E) of 10, and the BLOSUM62 scoring matrix, and with the proportion of identical amino acids in parentheses; Column 7).

TABLE 2

Conserved 'Myb DNA binding domain 1' of AtMYB19 and closely related sequences

| Col. 1 SEQ ID NO: | Col. 2 Species/ Identifier | Col. 3 Percent identity of polypeptide in Col. 1 to AtMYB19 | Col. 4 Myb DNA binding domain 1 in amino acid coordinates | Col. 5 Conserved Myb DNA binding domain 1 | Col. 6 SEQ ID NO: of Myb DNA binding domain 1 | Col. 7 Percent identity of first Myb domain in Col. 5 to Myb DNA binding domain 1 of AtMYB19 |
|---|---|---|---|---|---|---|
| 2 | At/AtMYB19 AT5G52260.1 | 100% (268/268) | 17-77 | WSPEEDQKLKSFILSR GHACWTTVPILAGLQ RNGKSCRLRWINYLR PGLKRGSFSEEEEET | 61 | 100% (61/61) |
| 4 | At/ AT4G25560.1 | 60% (169/280) | 15-75 | WSPEEDEKLRSFILSY GHSCWTTVPIKAGLQ RNGKSCRLRWINYLR PGLKRDMISAEEEET | 62 | 85% (52/61) |
| 6 | Os/LOC_Os 04g45020.1 | 48% (96/200) | 18-78 | WSPEEDQKLRDFILRY GHGCWSAVPVKAGLQ RNGKSCRLRWINYLR PGLKHGMFSREEEET | 63 | 80% (49/61) |
| 8 | Bd/Bradi 5g16672.1 | 53% (102/192) | 18-78 | WSPEEDQKLRDYIIRY GHSCWSTVPVKAGLQ RNGKSCRLRWINYLR PGLKHGMFSQEEEET | 64 | 78% (48/61) |
| 10 | Zm/GRMZM2G 170049_T01 | 50% (97/191) | 18-78 | WSPEEDQKLRDYILLH GHGCWSALPAKAGLQ RNGKSCRLRWINYLR PGLKHGMFSPEEEET | 65 | 77% (47/61) |
| 12 | Si/ Si012304m | 48% (98/202) | 18-78 | WSPEEDEKLRDFILRY GHGCWSALPAKAGLQ RNGKSCRLRWINYLR PGLKHGMFSREEEET | 66 | 77% (47/61) |
| 14 | Cc/clementine 0.9_033485m | 48% (115/237) | 22-82 | WSPEEDQRLKNYVLQH GHPCWSSVPINAGLQ RNGKSCRLRWINYLR PGLKRGVFNMQEEET | 67 | 77% (47/61) |
| 16 | Pt/POPTR_ 0015s13190.1 | 50% (109/217) | 22-82 | WSPEEDQRLRNYVLKH GHGCWSSVPINAGLQ RNGKSCRLRWINYLR PGLKRGTFSAQEEET | 68 | 77% (47/61) |

TABLE 2-continued

Conserved 'Myb DNA binding domain 1'
of AtMYB19 and closely related sequences

| Col. 1 SEQ ID NO: | Col. 2 Species/ Identifier | Col. 3 Percent identity of polypeptide in Col. 1 to AtMYB19 | Col. 4 Myb DNA binding domain 1 in amino acid coordinates | Col. 5 Conserved Myb DNA binding domain 1 | Col. 6 SEQ ID NO: of Myb DNA binding domain 1 | Col. 7 Percent identity of first Myb domain in Col. 5 to Myb DNA binding domain 1 of AtMYB19 |
|---|---|---|---|---|---|---|
| 18 | Eg/EUCGR. K00250.1 | 49% (107/217) | 18-78 | WSPEEDQKLRNYVLKH GHGCWSSVPINTGLQ RNGKSCRLRWINYLR PGLKRGMFTMEEEEI | 69 | 76% (46/60) |
| 20 | Eg/EUCGR. K00251.1 | 48% (110/226) | 18-78 | WSPEEDQRLRNYILNH GHGYWSSVPINTGLQ RNGKSCRLRWINYLR PGLKRGMFTLEEEEI | 70 | 75% (45/60) |
| 22 | Pt/POPTR_ 0012s13260.1 | 48% (109/223) | 52-112 | WSPEEDQRLGSYVFQH GHGCWSSVPINAGLQ RTGKSCRLRWINYLR PGLKRGAFSTDEEET | 71 | 75% (46/61) |
| 24 | Gm/Glyma 16g31280.1 | 48% (116/238) | 18-78 | WSPEEDNKLRNHIIKH GHGCWSSVPIKAGLQ RNGKSCRLRWINYLR PGLKRGVFSKHEEDT | 72 | 75% (46/61) |
| 26 | Gm/Glyma 09g25590.1 | 49% (103/209) | 18-78 | WSPEEDNKLRNHIIKH GHGCWSSVPIKAGLQ RNGKSCRLRWINYLR PGLKRGVFSKHEKDT | 73 | 73% (45/61) |
| 28 | Sl/Solyc 03g025870.2.1 | 40% (115/283) | 19-79 | WSPDEDDRLKNYMIKH GHGCWSSVPINAGLQ RNGKSCRLRWINYLR PGLKRGAFSLEEEDI | 74 | 73% (44/60) |
| 30 | Vv/GSVIVT 01028984001 | 42% (115/272) | 20-80 | WSPEEDARLRNYVLKY GLGCWSSVPVNAGLQ RNGKSCRLRWINYLR PGLKRGMFTIEEEET | 75 | 72% (44/61) |
| 32 | Eg/EUCGR. A02796.1 | 51% (112/217) | 18-78 | WSPDEDQRLRNYIHKH GYSCWSSVPINAGLQ RNGKSCRLRWINYLR PGLKRGAFTVQEEET | 76 | 70% (44/61) |
| 34 | At/ AT3G48920.1 | 51%) (99/191) | 23-83 | WSPEEDEKLRSHVLKY GHGCWSTIPLQAGLQ RNGKSCRLRWVNYLR PGLKKSLFTKQEETI | 77 | 69% (41-59) |

TABLE 3

Conserved second Myb DNA binding domains
of AtMYB19 and closely related sequences

| Col. 1 SEQ ID NO: | Col. 2 Species/ Identifier | Col. 3 Percent identity of polypeptide in Col. 1 to AtMYB19 | Col. 4 Myb DNA binding domain 2 in amino acid coordinates | Col. 5 Conserved Myb DNA binding domain 2 | Col. 6 SEQ ID NO: of second Myb domain | Col. 7 Percent identity of second Myb in Col. 5 to Myb DNA binding domain 2 of AtMYB19 |
|---|---|---|---|---|---|---|
| 2 | At/AtMYB19 AT5G52260.1 | 100% (268/268) | 70-112 | FSEEEEETILTLHSS LGNKWSRIAKYLPGR TDNEIKNYWHSYL | 95 | 100% (43/43) |

TABLE 3-continued

Conserved second Myb DNA binding domains of AtMYB19 and closely related sequences

| Col. 1 SEQ ID NO: | Col. 2 Species/ Identifier | Col. 3 Percent identity of polypeptide in Col. 1 to AtMYB19 | Col. 4 Myb DNA binding domain 2 in amino acid coordinates | Col. 5 Conserved Myb DNA binding domain 2 | Col. 6 SEQ ID NO: of second Myb DNA binding domain | Col. 7 Percent identity of second Myb domain in Col. 5 to Myb DNA binding domain 2 of AtMYB19 |
|---|---|---|---|---|---|---|
| 4 | At/ AT4G25560.1 | 60% (169/280) | 68-110 | ISAEEEETILTFHSS LGNKWSQIAKFLPGR TDNEIKNYWHSHL | 96 | 88% (37/42) |
| 6 | Os/LOC_ Os04g45020.1 | 48% (96/200) | 71-113 | FSREEEETVMNLHAT MGNKWSQIARHLPGR TDNEVKNYWNSYL | 97 | 72% (31/43) |
| 8 | Bd/ Bradi5g16672.1 | 53% (102/192) | 71-113 | FSQEEEETVMSLHAT LGNKWSRIAQHLPGR TDNEVKNYWNSYL | 98 | 76% (33/43) |
| 10 | Zm/GRMZM2 G170049_T01 | 50% (97/191) | 71-113 | FSPEEEETVMSLHAT LGNKWSRIARHLPGR TDNEVKNYWNSYL | 99 | 76% (33/43) |
| 12 | Si/Si012304m | 48% (98/202) | 71-113 | FSREEEETVMSLHAK LGNKWSQIARHLPGR TDNEVKNYWNSYL | 100 | 74% (32/43) |
| 14 | Cc/clementine 0.9_033485m | 48% (115/237) | 75-117 | FNMQEEETILTVHRL LGNKWSQIAQHLPGR TDNEIKNYWHSHL | 101 | 76% (33/43) |
| 16 | Pt/POPTR_ 0015s13190.1 | 50% (109/217) | 75-117 | FSAQEEETILALHHM LGNKWSQIAQHLPGR TDNEIKNHWHSYL | 102 | 79% (34/43) |
| 18 | Eg/EUCGR. K00250.1 | 49% (107/217) | 71-113 | FTMEEEEIIFSLHHL IGNKWSQIAKHLPGR TDNEIKNHWHSYL | 103 | 74% (32/43) |
| 20 | Eg/EUCGR. K00251.1 | 48% (110/226) | 71-113 | FTLEEEEIILSLHRL IGNKWSQIAKHLPGR TDNEIKNHWHSYL | 104 | 76% (33/43) |
| 22 | Pt/POPTR_ 0012s13260.1 | 48% (109/223) | 105-147 | FSTDEEETILTLHRM LGNKWSQIAQHLPGR TDNEIKNHWHSYL | 105 | 81% (35/43) |
| 24 | Gm/Glyma 16g31280.1 | 48% (116/238) | 71-113 | FSKHEEDTIMVLHHM LGNKWSQIAQHLPGR TDNEIKNYWHSYL | 106 | 76% (33/43) |
| 26 | Gm/Glyma 09g25590.1 | 49% (103/209) | 71-113 | FSKHEKDTIMALHHM LGNKWSQIAQHLPGR TDNEVKNYWHSYL | 107 | 72% (31/43) |
| 28 | Sl/Solyc 03g025870.2.1 | 40% (115/283) | 72-114 | FSLEEEDIILTLHAM FGNKWSQIAQQLPGR TDNEIKNHWHSYL | 108 | 76% (33/43) |
| 30 | Vv/GSVIVT 01028984001 | 42% (115/272) | 73-115 | FTIEEEETIMALHRL LGNKWSQIAQNFPGR TDNEIKNYWHSCL | 109 | 74% (32/43) |
| 32 | Eg/EUCGR. A02796.1 | 51% (112/217) | 71-113 | FTVQEEETILNLHHL LGNKWSQIAQHLPGR TDNEIKNHWHSYL | 110 | 76% (33/43) |

TABLE 3-continued

Conserved second Myb DNA binding domains
of AtMYB19 and closely related sequences

| Col. 1 SEQ ID NO: | Col. 2 Species/ Identifier | Col. 3 Percent identity of polypeptide in Col. 1 to AtMYB19 | Col. 4 Myb DNA binding domain 2 in amino acid coordinates | Col. 5 Conserved Myb DNA binding domain 2 | Col. 6 SEQ ID NO: of second Myb domain | Col. 7 Percent identity of second Myb domain in Col. 5 to Myb DNA binding domain 2 of AtMYB19 |
|---|---|---|---|---|---|---|
| 34 | At/ AT3G489201.1 | 51% (99/191) | 76-118 | FTKQEETILLSLHSM LGNKWSQISKFLPGR TDNEIKNYWHSNL | 111 | 72% (31/43) |

Species abbreviations for Tables 2 and 3:
At—*Arabidopsis thaliana*;
Bd—*Brachypodium distachyon*;
Cc—*Citrus x clementina*;
Eg—*Eucalyptus grandis*;
Gm—*Glycine max*;
Os—*Oryza sativa*;
Pt—*Populus trichocarpa*;
Si—*Setaria italica*;
Sl—*Solanum lycopersicum*;
Vv—*Vitis vinifera*;
Zm—*Zea mays*

Sequences that are functionally-related and/or closely-related to the polypeptides in Tables 2 and 3 may be created artificially, semi-synthetically, or may occur naturally by having descended from the same ancestral sequence as the disclosed AtMYB19-related sequences, where the polypeptides have the function of conferring increased photosynthetic resource use efficiency to plants. These "functionally-related and/or closely-related" AtMYB19 clade polypeptides generally contain the consensus sequence of the Myb DNA binding domain 1 of SEQ ID NO: 129:

WSPX$^1$EDxxLxxxX$^2$xxxGxxxWX$^3$xX$^2$PxxxGLQRxGKSCRLRW X$^2$NYLRPGLKxxxxxxxxE;

where x represents any amino acid;
X$^1$ is D or E;
X$^2$ is I, V, L or M;
and X$^3$ represents S or T;
as provided in FIG. 2B-2C.

Figure 2D:
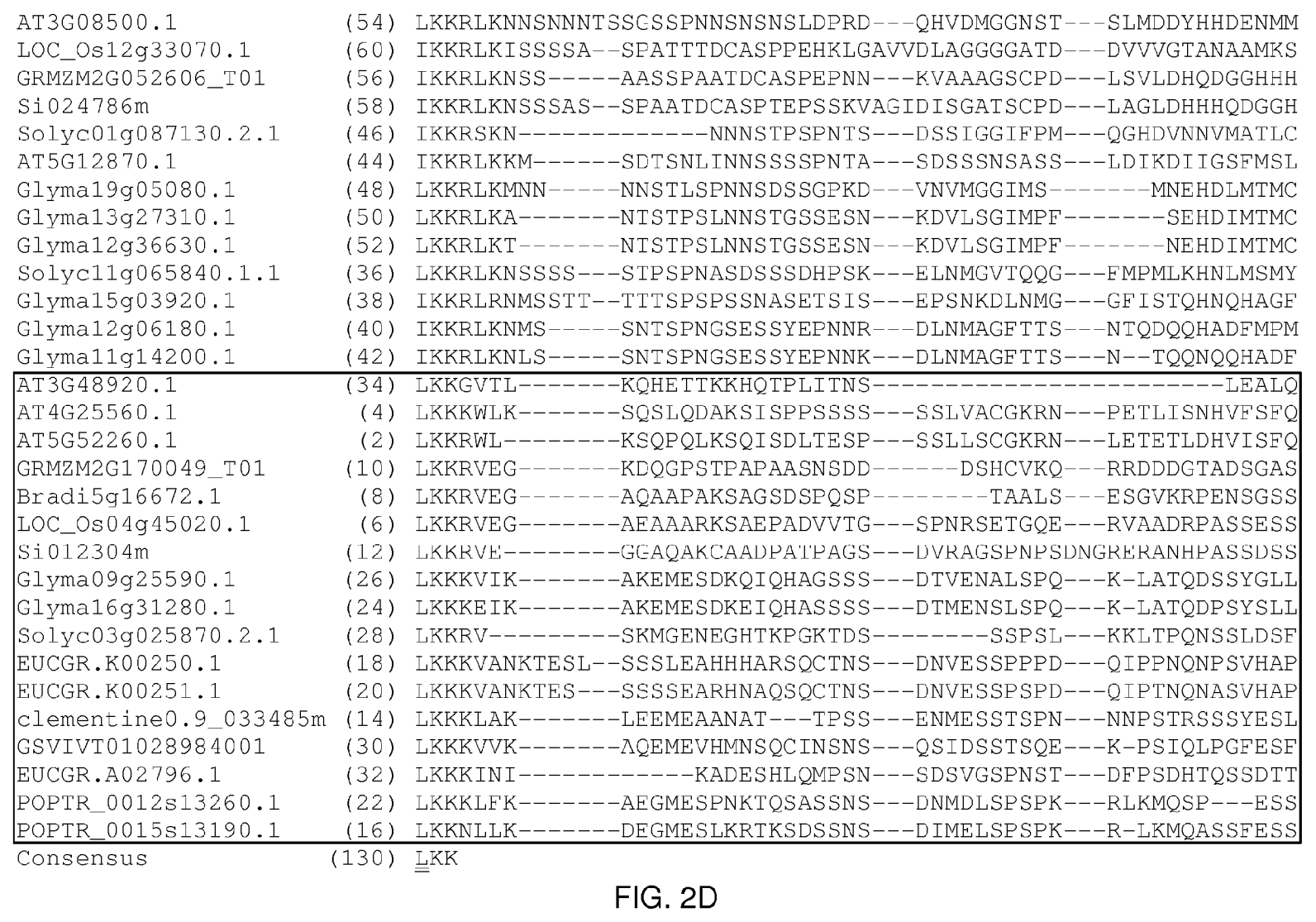

Other highly conserved residues found in the Myb DNA binding domain 2 of AtMYB19 clade members, as shown in FIG. 2C-2D and SEQ ID NO: 130:
ExxxX$^1$xxxHxxxGNKWSxIX$^2$xxxPGRTDNEX$^1$KNxWxSxL
where x represents any amino acid;
X$^1$ is I, V, L or M; and
X$^2$ represents A or S.

There is also a small motif that is present in AtMYB19 clade member proteins, identifiable as SEQ ID NO: 133 and that can be located spanning FIGS. 2E-2F:

PxFxX$^1$W where x represents any amino acid; and
X$^1$ is D or E.

The presence of one or more of these consensus sequences and/or these amino acid residues is correlated with conferring of improved or increased photosynthetic resource use efficiency to a plant when the expression level of the polypeptide is altered in a plant by being reduced, knocked-out, or overexpressed. An AtMYB19 clade polypeptide sequence that is "functionally-related and/or closely-related" to the listed full length protein sequences or domains provided in Tables 2 or 3 may also have at least 40%, 42%, 48%, 49%, 50%, 51%, 53%, 60%, or about 100% amino acid identity to SEQ ID NO: 2 or to SEQ ID NO: 4, 6, 8, 10, 12, 14, 16, 18, 20, 22, 24, 26, 28, 30, 32, 34, and/or at least 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% amino acid identity to the first Myb DNA binding domain of SEQ ID NO: 2, or to a listed first Myb DNA binding domain or to SEQ ID NOs: 61-77, and/or 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% amino acid identity to a listed second Myb DNA binding domain or to the second Myb DNA binding domain of SEQ ID NO: 2 or SEQ ID NOs: 95-111, or to an amino acid sequence having at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% or at least 96%, at least 97%, at least 98%, at least 99%, or about 100% sequence identity to SEQ ID NOs: 129-132. The presence of the disclosed conserved first Myb DNA binding domains and/or second Myb DNA binding domains in the polypeptide sequence (for example, SEQ ID NO: 61-77 or 95-111), is correlated with the conferring of improved or increased photosynthetic resource use efficiency to a plant when the expression level of the polypeptide is altered in a plant by being reduced, knocked-out, or overexpressed. All of the sequences that adhere to these functional and sequential relationships are herein referred to as "AtMYB19 clade polypeptides" or "AtMYB19 clade polypeptides", or which fall within the "AtMYB19 clade" or "G1309 clade" exemplified in the tree in FIG. 1 as those polypeptides bounded by LOC_Os04g45020.1 and Solyc03g025870.2.1 (indicated by the box around these sequences).

TABLE 4

Conserved 'Myb DNA binding domain 1' of AtMYB50 and closely related sequences

| Col. 1 SEQ ID NO: | Col. 2 Species/ Identifier | Col. 3 Percent identity of polypeptide in Col. 1 to AtMYB50 | Col. 4 Myb DNA binding domain 1 in amino acid coordinates | Col. 5 Conserved Myb DNA binding domain 1 | Col. 6 SEQ ID NO: of Myb DNA binding domain 1 | Col. 7 Percent identity of first Myb domain in Col. 5 to Myb DNA binding domain 1 of AtMYB50 |
|---|---|---|---|---|---|---|
| 135 | At/AtMYB50 or AT1G57560.1 | 100% (314/314) | 14-61 | KGLWSPEEDEKLLNYITKHGHGCWSSVPKLAGLERCGKSCRLRWINYL | 210 | 100% (48/48) |
| 151 | Gm/Glyma19g41250.1 | 86% (118/138) | 14-61 | KGLWSPEEDEKLLNYITKHGHGCWSSVPKLAGLQRCGKSCRLRWINYL | 234 | 98% (47/48) |
| 157 | Gm/Glyma03g38660.1 | 86% (118/138) | 14-61 | KGLWSPEEDEKLLNYITKHGHGCWSSVPKLAGLQRCGKSCRLRWINYL | 222 | 98% (47/48) |
| 147 | Gm/Glyma20g22230.1 | 90% (121/135) | 14-61 | KGLWSPEEDEKLLNYITKHGHGCWSSVPKLAGLQRCGKSCRLRWINYL | 232 | 98% (47/48) |
| 139 | At/AT5G26660.1 | 64% (131/206) | 14-61 | KGLWSPEEDEKLLNYITRHGHGCWSSVPKLAGLQRCGKSCRLRWINYL | 214 | 96% (46/48) |
| 153 | Pt/POPTR_0013s00290.1 | 44% (192/444) | 14-61 | KGLWSPEEDEKLLNYITKHGLGCWSSVPKLAGLQRCGKSCRLRWINYL | 218 | 96% (46/48) |
| 141 | Gm/Glyma10g28250.1 | 91% (119/132) | 14-61 | KGLWSPEEDEKLLNHITKHGHGCWSSVPKLAGLQRCGKSCRLRWINYL | 216 | 96% (46/48) |
| 143 | Pt/POPTR_0005s00340.1 | 45% (196/440) | 14-61 | KGLWSPEEDEKLLNYITKHGHGCWSSVPKQADLQRCGKSCRLRWINYL | 230 | 94% (45/48) |
| 185 | Zm/GRMZM2G171781_T01 | 87% (116/134) | 14-61 | KGLWSPEEDEKLMNHITKHGHGCWSSVPKLAGLQRCGKSCRLRWINYL | 260 | 94% (45/48) |
| 191 | Os/LOC_Os05g04820.1 | 89% (118/134) | 14-61 | KGLWSPEEDEKLMNHITKHGHGCWSSVPKLAGLQRCGKSCRLRWINYL | 266 | 94% (45/48) |
| 137 | At/AT1G09540.1 | 58% (211/367) | 14-61 | KGLWSPEEDEKLLTHITNHGHGCWSSVPKLAGLQRCGKSCRLRWINYL | 212 | 92% (44/48) |
| 149 | Eg/Eucgr.H01337.1 | 75% (124/166) | 14-61 | KGLWSPEEDEKLLNYITTYGHGCWSAVPKLAGLQRCGKSCRLRWINYL | 226 | 92% (44/48) |
| 159 | Eg/Eucgr.B01827.1 | 87% (113/130) | 67-114 | KGLWSPEEDEKLLNYIAKFGLGCWSSVPKLAGLQRCGKSCRLRWINYL | 224 | 92% (44/48) |

TABLE 4-continued

Conserved 'Myb DNA binding domain 1' of AtMYB50 and closely related sequences

| Col. 1 SEQ ID NO: | Col. 2 Species/ Identifier | Col. 3 Percent identity of polypeptide in Col. 1 to AtMYB50 | Col. 4 Myb DNA binding domain 1 in amino acid coordinates | Col. 5 Conserved Myb DNA binding domain 1 | Col. 6 SEQ ID NO: of Myb DNA binding domain 1 | Col. 7 Percent identity of first Myb domain in Col. 5 to Myb DNA binding domain 1 of AtMYB50 |
|---|---|---|---|---|---|---|
| 165 | Os/ LOC_Os01g18240.1 | 82% (124/153) | 14-61 | KGLWSPEEDEKLMNH ITKHGHGCWSTVPKL AGLQRCGKSCRLRWI NYL | 240 | 92% (44/48) |
| 193 | Vv/ GSVIVT010313 41001 | 88% (116/132) | 14-61 | KGLWSPEEDEKLLMH ITKYGHGCWSSVPKL AGLQRCGKSCRLRWI NYL | 192 | 92% (44/48) |
| 199 | Zm/ GRMZM2G017520_ T01 | 67% (128/192) | 14-61 | KGLWSPEEDEKLMNH ITKHGHGCWSTVPKL AGLQRCGKSCRLRWI NYL | 274 | 92% (44/48) |
| 205 | Zm/ GRMZM2G127490_ T01 | 80% (122/153) | 14-61 | KGLWSPEEDEKLMNH ITKHGHGCWSSIPKL AGLQRCGKSCRLRWI NYL | 280 | 92% (44/48) |
| 161 | Sl/ Solyc01g 102340.2.1 | 82% (118/144) | 14-61 | KGLWSPEEDEKLIKH ITKFGHGCWSSVPKL AGLQRCGKSCRLRWI NYL | 236 | 90% (43/48) |
| 163 | Gm/ Glyma19g 41010.1 | 66% (130/197) | 14-61 | KGLWSPEEDEKLLRH ITKYGHGCWSSVPKQ AGLQRCGKSCRLRWI NYL | 238 | 90% (43/48) |
| 181 | Gm/ Glyma02g 00960.1 | 89% (117/132) | 14-61 | KGLWSPEEDEKLLRH ITKYGHGCWSSVPKQ AGLQRCGKSCRLRWI NYL | 256 | 90% (43/48) |
| 183 | Vv/ GSVIVT010282 35001 | 83% (119/145) | 14-61 | KGLWSPEEDEKLLRH ITKYGHGCWSSVPKQ AGLQRCGKSCRLRWI NYL | 258 | 90% (43/48) |
| 155 | Vv/ GSVIVT010177 16001 | 78% (113/145) | 14-61 | RGLWSPEEDEKLFRY ITEHGHGCWSSVPKQ AGLQRCGKSCRLRWI NYL | 220 | 88% (42/48) |
| 179 | Zm/ GRMZM2G147698_ T01 | 64% (103/161) | 14-61 | RGLWSPEEDEKLMNH IAKYGHGCWSSVPKL AGLDRCGKSCRLRWI NYL | 254 | 88% (42/48) |
| 203 | Sl/ Solyc10g 044680.1.1 | 80% (103/130) | 13-60 | KGLWCPEEDEKLINH VTKYGHGCWSSVPKL AALQRCGKSCRLRWI NYL | 278 | 86% (41/48) |
| 197 | At/ AT4G01680.2 | 74% (119/163) | 14-73 | KGLWSPEEDEKLLRY ITKYGHGCWSSVPKQ AGTFLFIQIHLLFGL QRCGKSCRLRWINYL | 272 | 74% (44/60) |
| 143 | Cc/ clementine0.9_ 009770m | 42% (192/462) | 14-89 | KGLWSPEEDEKLLNY ITKHGHGCWSSVPKL AGKIYLENNHACSV ILMFNAFNTMFLLAG LQRCGKSCRLRWINY L | 228 | 62% (47/76) |

TABLE 5

Conserved second Myb DNA binding domains of AtMYB50 and closely related sequences

| Col. 1 SEQ ID NO: | Col. 2 Species/ Identifier | Col. 3 Percent identity of polypeptide in Col. 1 to AtMYB50 | Col. 4 Myb DNA binding domain 2 in amino acid coordinates | Col. 5 Conserved Myb DNA binding domain 2 | Col. 6 SEQ ID NO: of second Myb domain | Col. 7 Percent identity of second Myb domain in Col. 5 to Myb DNA binding domain 2 of AtMYB50 |
|---|---|---|---|---|---|---|
| 135 | At/AtMYB50 or AT1G57560.1 | 100% (314/314) | 67-112 | RGAFSSEEQNLIVEL HAVLGNRWSQIAARL PGRTDNEIKNLWNSC I | 211 | 100% (44/44) |
| 137 | At/ AT1G09540.1 | 58% (211/367) | 67-112 | RGAFSPEEENLIVEL HAVLGNRWSQIASRL PGRTDNEIKNLWNSS I | 213 | 92% (42/46) |
| 165 | Os/ LOC_Os01g 18240.1 | 82% (124/153) | 67-112 | RGAFSQEEEDLIVEL HAVLGNRWSQIATRL PGRTDNEIKNLWNSC I | 241 | 92% (42/46) |
| 143 | Pt/ POPTR_0005s 00340.1 | 45% (196/440) | 67-112 | RGAFSQQEENLIIEL HAVLGNRWSQIAAQL PGRTDNEIKNLWNSC I | 231 | 90% (41/46) |
| 153 | Pt/ POPTR_0013s 00290.1 | 44% (192/444) | 67-112 | RGAFSQQEENLIIEL HAVLGNRWSQIAAQL PGRTDNEIKNLWNSC I | 219 | 90% (41/46) |
| 191 | Os/ LOC_Os05g 04820.1 | 89% (118/134) | 67-112 | RGAFSQEEEDLIIEL HAVLGNRWSQIAAQL PGRTDNEIKNLWNSC I | 277 | 90% (41/46) |
| 199 | Zm/ GRMZM2G017520_ T01 | 67% (128/192) | 67-112 | RGAFSEEEEDLIVEL HAVLGNRWSQIATRL PGRTDNEIKNLWNSS I | 275 | 90% (41/46) |
| 141 | Gm/ Glyma10g28250.1 | 91% (119/132) | 67-112 | RGAFSQQEENMIVEL HAVLGNRWSQIAAQL PGRTDNEIKNLWNSC L | 217 | 87% (40/46) |
| 145 | Cc/ clementine0.9_ 009770m | 42% (192/462) | 95-140 | RGAFSVQEESLIVEL HAVLGNRWSQIAAQL PGRTDNEIKNLWNSS I | 229 | 87% (40/46) |
| 147 | Gm/ Glyma20g22230.1 | 90% (121/135) | 67-112 | RGAFSQQEENMIVEL HAVLGNRWSQIAAQL PGRTDNEIKNLWNSC L | 233 | 87% (40/46) |
| 157 | Gm/ Glyma03g38660.1 | 86% (118/138) | 67-112 | RGAFSQQEENSIVEL HAVLGNRWSQIAAQL PGRTDNEIKNLWNSC L | 223 | 87% (40/46) |
| 159 | Eg/ Eucgr.B01827.1 | 87% (113/130) | 120-165 | RGAFSQQEESLIIEL HAVLGNRWSQIAAHL PGRTDNEIKNLWNSG L | 225 | 87% (38/44) |
| 181 | Gm/ Glyma02g00960.1 | 89% (117/132) | 67-112 | RGTFSQEEENLIIEL HAVLGNRWSQIAAQL PGRTDNEIKNLWNSC L | 257 | 87% (40/46) |

TABLE 5-continued

Conserved second Myb DNA binding domains of AtMYB50 and closely related sequences

| Col. 1 SEQ ID NO: | Col. 2 Species/ Identifier | Col. 3 Percent identity of polypeptide in Col. 1 to AtMYB50 | Col. 4 Myb DNA binding domain 2 in amino acid coordinates | Col. 5 Conserved Myb DNA binding domain 2 | Col. 6 SEQ ID NO: of second Myb domain | Col. 7 Percent identity of second Myb domain in Col. 5 to Myb DNA binding domain 2 of AtMYB50 |
|---|---|---|---|---|---|---|
| 193 | Vv/ GSVIVT01031341001 | 88% (116/132) | 67-112 | RGAFSQQEESLIIEL HAVLGNRWSQIAAQL PGRTDNEIKNLWNSC I | 193 | 87% (40/46) |
| 197 | At/ AT4G01680.2 | 74% (119/163) | 79-124 | RGAFSQDEENLIIEL HAVLGNRWSQIAAQL PGRTDNEIKNLWNSC L | 273 | 87% (40/46) |
| 205 | Zm/ GRMZM2G127490_T01 | 80% (122/153) | 67-112 | RGAFSQDEEDLIIEL HAVLGNRWSQIAAQL PGRTDNEIKNLWNSC I | 281 | 87% (40/46) |
| 149 | Eg/ Eucgr.H01337.1 | 75% (124/166) | 67-112 | RGAFSHQEENLIIEL HAVLGNRWSQIAARL PGRTDNEIKNFWNSS L | 227 | 85% (39/46) |
| 151 | Gm/ Glyma19g41250.1 | 86% (118/138) | 67-112 | RGAFSQQEENLIIEL HAVLGNRWSQIAAQL PGRTDNEIKNLWNSC L | 235 | 85% (39/46) |
| 161 | Sl/ Solyc01g102340.2.1 | 82% (118/144) | 67-112 | RGTFSQDEENLIIEL HAVLGNKWSQIAARL PGRTDNEIKNLWNSS I | 237 | 85% (39/46) |
| 163 | Gm/ Glyma19g41010.1 | 66% (130/197) | 67-112 | RGTFSQEEETLIIEL HAVLGNRWSQIAAQL PGRTDNEIKNLWNSC L | 239 | 85% (39/46) |
| 185 | Zm/ GRMZM2G171781_T01 | 87% (116/134) | 67-112 | RGAFAQDEEDLIIEL HAVLGNRWSQIAAQL PGRTDNEIKNLWNSC I | 261 | 85% (39/46) |
| 183 | Vv/ GSVIVT01028235001 | 83% (119/145) | 67-112 | RGTFSLQEENLIIEL HSVLGNRWSQIAAQL PGRTDNEIKNLWNSC L | 259 | 83% (38/46) |
| 139 | At/ AT5G26660.1 | 64% (131/206) | 67-112 | RGAFSQDEESLIIEL HAALGNRWSQIATRL PGRTDNEIKNLWNSC L | 215 | 81% (37/46) |
| 155 | Vv/ GSVIVT01017716001 | 78% (113/145) | 67-112 | RGAFTGQEEKLIVEL HEILGNRWSQIASHL PGRTDNEIKNQWNSS I | 221 | 77% (35/46) |
| 203 | Sl/ Solyc10g044680.1.1 | 80% (103/130) | 66-111 | RGTFSQQEENLIIQL HSLLGNKWSQIASRL PGRTDNEIKNLWNSS I | 279 | 77% (35/46) |

TABLE 5-continued

Conserved second Myb DNA binding domains
of AtMYB50 and closely related sequences

| Col. 1 SEQ ID NO: | Col. 2 Species/ Identifier | Col. 3 Percent identity of polypeptide in Col. 1 to AtMYB50 | Col. 4 Myb DNA binding domain 2 in amino acid coordinates | Col. 5 Conserved Myb DNA binding domain 2 | Col. 6 SEQ ID NO: of second Myb domain | Col. 7 Percent identity of second Myb domain in Col. 5 to Myb DNA binding domain 2 of AtMYB50 |
|---|---|---|---|---|---|---|
| 179 | Zm/ GRMZM2G147698_T01 | 64% (103/161) | 67-112 | RGTFSQEEEDLIIHL HSLLGNKWSQIAAQL PGRTDNEVKNFWNSY I | 255 | 72% (33/46) |

Figure 6C:
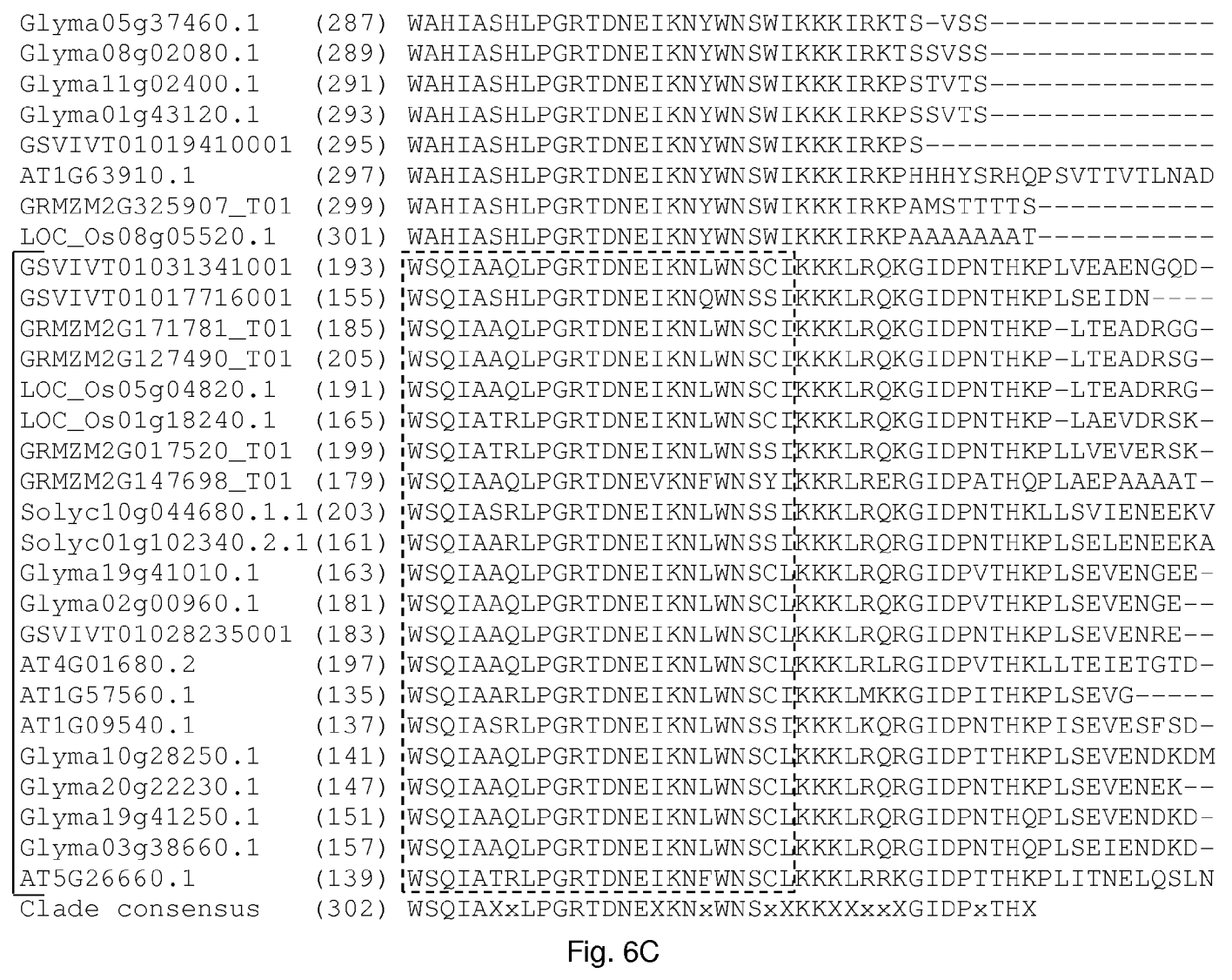

Species abbreviations for Tables 4 and 5:
At—Aralidopsis thaliana;
Bd—Brachypodium distachyon;
Cc—Citrus clementina;
Eg—Eucalyptus grandis;
Gm—Glycine max;
Os—Oryza sativa;
Pt—Populus trichocarpa;
Si—Setaria italica;
Sl—Solanum lycopersicum;
Vv-Vitis vinifera;
Zm—Zea mays As shown in FIG. 6A-6C, these "functionally-related and/or closely-related" AtMYB50 clade polypeptides generally contain a consensus sequence of the AtMYB50 clade, SEQ ID NO: 302:

$X^1$GLWX$^2$PEEDEKLxxxX$^3$X$^4$xxGHGCWSX$^5$X$^3$PKxAxX$^8$X$^9$X$^{10}$X$^9$ $X^{11}X^{12}X^{11}X^{13}X^{10}X^{10}X^9X^{14}$LxRCGKSCRLRWINYLRPDX$^3$X$^1$RGX$^4$ FX$^6$xxExxxIX$^3$xLHxxX$^3$GNX$^1$WSQIAX$^6$xLPGRTDNEX$^3$KNxW NSxX$^3$KKX$^1$X$^3$xxX$^1$GIDPxTHX$^7$.*

As shown in FIG. 6A-6B, these "functionally-related and/or closely-related" AtMYB50 clade polypeptides also generally contain a consensus sequence Myb DNA binding domain 1, SEQ ID NO: 303:

$X^1$GLWX$^2$PEEDEKLxxxX$^3$X$^4$xxGHGCWSX$^5$X$^3$PKxAxX$^8$X$^9$X$^{10}$X$^9$ $X^{11}X^{12}X^{11}X^{13}X^{10}X^{10}X^9X^{14}$LxRCGKSCRLRWINYL.*

As shown in FIG. 6B-6C, the instant "functionally-related and/or closely-related" AtMYB50 clade polypeptides also generally contain a consensus sequence Myb DNA binding domain 2, SEQ ID NO: 304 (said sequence is underlined in FIG. 6B-6C):

RGX$^4$FX$^6$xxExxxIX$^3$xLHxxX$^3$GNX$^1$WSQIAX$^6$xLPGRTDNEX$^3$

KNxWNSxX$^3$.*

There is also a small motif that is present in AtMYB50 clade member proteins, and is identifiable as SEQ ID NO: 305 (said sequence is double underlined in FIG. 6C):

$X^1$GIDPxTHX$^7$.*

*In the above consensus sequences of SEQ ID NO: 302-305, x represents any amino acid; $X^1$ is K or R; $X^2$ is S or C; $X^3$ is I, V, L, or M; $X^4$ is T or A; $X^5$ is S or T; $X^6$ is S, A, or T; $X^7$ is K or Q; $X^8$ is T or absent; $X^9$ is F or absent; $X^{10}$ is L or absent; $X^{11}$ is I or absent; $X^{12}$ is Q or absent; $X^{13}$ is H or absent; and $X^{14}$ is G or absent.

The presence of one or more of these consensus sequences and/or these amino acid residues is correlated with conferring of improved or increased photosynthetic resource use efficiency to a plant when the expression level of the polypeptide is altered in a plant by being reduced, knocked-out, or overexpressed. An AtMYB50 clade polypeptide sequence that is "functionally-related and/or closely-related" to the listed full length protein sequences or domains provided in Tables 4 or 5 may also have at least 42%, 44%, 45%, 58%, 64%, 66%, 67%, 74%, 75%, 78%, 80%, 82%, 83%, 86%, 87%, 88%, 89%, 90%, 91%, or about 100% amino acid identity to SEQ ID NO 135, and/or at least 62%, 74%, 86%, 88%, 90%, 92%, 94%, 96%, 98% or about 100% amino acid identity to the first Myb DNA binding domain of SEQ ID NO 135, and/or at least 72%, 77%, 81%, 83%, 85%, 87%, 90%, 92%, or about 100% amino acid identity to the second Myb DNA binding domain of SEQ ID NO 135 in its amino acid sequence to the entire length of a listed sequence or to a listed first Myb DNA binding domains, or to a listed second Myb DNA binding domains, or to the amino acid sequence of SEQ ID NO 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, or 210-285. The presence of the disclosed conserved first Myb DNA binding domains and/or second Myb DNA binding domains in the polypeptide sequence (for example, SEQ ID NO: 210-285), is correlated with the conferring of improved or increased photosynthetic resource use efficiency to a plant when the expression level of the polypeptide is altered in a plant by being reduced, knocked-out, or overexpressed. All of the sequences that adhere to these functional and sequential relationships are herein referred to as "AtMYB50 clade polypeptides" or "AtMYB50 clade polypeptides", or which fall within the "AtMYB50 clade" or "G1319 clade" exemplified in the phylogenetic tree in FIG. 5 as those polypeptides bounded by LOC_Os01g18240.1 and POPTR_0013 s00290.1 (indicated by the box around these sequences).

TABLE 6

Conserved AP2 domain of CRF1 and closely related sequences

| Col. 1 SEQ ID NO: | Col. 2 Species/ Identifier | Col. 3 Percent identity of polypeptide in Col. 1 to CRF1 | Col. 4 AP2 domain in amino acid coordinates | Col. 5 Conserved AP2 domain | Col. 6 SEQ ID NO: of AP2 domain | Col. 7 Percent identity of AP2 domain in Col. 5 to AP2 domain of CRF1 |
|---|---|---|---|---|---|---|
| 307 | At/CRF1 or AT4G11140.1 | 100% (287/287) | 87-142 | FRGVRQRPWGKWAAE IRDPSRRVRVWLGTF DTAEEAAIVYDNAAI QLRGPNAELNF | 396 | 100% (56/56) |
| 333 | Gm/Glyma08g 02460.1 | 43% (125/295) | 109-164 | FRGVRQRPWGKWAAE IRDPSRRVRLWLGTY DTAEEAAIVYDNAAI QLRGADALTNF | 409 | 90% (50/56) |
| 331 | Gm/Glyma05g 37120.1 | 39% (125/328) | 109-164 | FRGVRQRPWGKWAAE IRDPLRRVRLWLGTY DTAEEAAIVYDNAAI QLRGADALTNF | 408 | 88% (49/56) |
| 335 | Gm/Glyma01g 43350.1 | 38% (109/294) | 107-162 | FRGVRQRPWGKWAAE IRDPSRRVRLWLGTY DTAEEAALVYDNAAI RLRGPHALTNF | 410 | 88% (49/56) |
| 341 | Zm/GRMZM2G 044077_T01 | 44% (79/183) | 118-173 | FRGVRRRPWGKYAAE IRDPWRRVRVWLGTF DTAEEAAKVYDSAAV QLRGRDATTNF | 413 | 88% (49/56) |
| 381 | Cc/clementine 0.9_015380m | 43% (131/310) | 120-175 | FRGVRQRPWGKWAAE IRDPLRRVRLWLGTY DTAEEAAMVYDNAAI QLRGPDALTNF | 433 | 88% (49/56) |
| 387 | Pt/POPTR_0001 s10300.1 | 43% (138/323) | 130-185 | FRGVRQRPWGKWAAE IRDPLRRVRLWLGTY DTAEEAAMVYDNAAI QLRGPDALTNF | 436 | 88% (49/56) |
| 319 | Sl/Solyc03g 007460.1.1 | 49% (95/195) | 129-184 | FRGVRQRPWGKWAAE IRDPARRVRLWLGTY DTAEEAAMVYDNAAI KLRGPDALTNF | 402 | 86% (48/56) |
| 321 | Sl/Solyc06g 051840.1.1 | 52% (94/182) | 125-180 | FRGVRQRPWGKWAAE IRDPARRVRLWLGTY DTAEEAAMVYDNAAI KLRGPDALTNF | 403 | 86% (48/56) |
| 323 | Gm/Glyma04g 41740.1 | 45% (100/227) | 103-158 | FRGVRQRPWGKWAAE IRDPARRVRLWLGTY DTAEEAAMVYDNAAI RLRGPDALTNF | 404 | 86% (48/56) |
| 325 | Gm/Glyma06g 13040.1 | 38% (114/303) | 102-157 | FRGVRQRPWGKWAAE IRDPARRVRLWLGTY DTAEEAAMVYDNAAI RLRGPDALTNF | 405 | 86% (48/56) |
| 337 | Sl/Solyc08g 081960.1.1 | 40% (128/322) | 138-193 | FRGVRQRPWGKWAAE IRDPLRRVRLWLGTY DTAEEAAMVYDHAAI QLRGPDALTNF | 411 | 86% (48/56) |
| 345 | Si/Si002247m | 40% (98/251) | 117-172 | FRGVRRRPWGKYAAE IRDPWRRVRVWLGTF DTAEEAAKVYDSAAI QLRGPDATTNF | 415 | 86% (48/56) |

TABLE 6-continued

Conserved AP2 domain of CRF1 and closely related sequences

| Col. 1 SEQ ID NO: | Col. 2 Species/ Identifier | Col. 3 Percent identity of polypeptide in Col. 1 to CRF1 | Col. 4 AP2 domain in amino acid coordinates | Col. 5 Conserved AP2 domain | Col. 6 SEQ ID NO: of AP2 domain | Col. 7 Percent identity of AP2 domain in Col. 5 to AP2 domain of CRF1 |
|---|---|---|---|---|---|---|
| 347 | Os/LOC_Os01g 46870.1 | 61% (61/101) | 103-158 | FRGVRRRPWGKFAAE IRDPWRGVRVWLGTF DTAEEAARVYDNAAI QLRGPSATTNF | 416 | 86% (48/56) |
| 373 | Cc/clementine 0.9_013577m | 37% (125/343) | 126-181 | FRGVRQRPWGKWAAE IRDPARRVRLWLGTY DTAEEAARVYDNAAI KLRGPDALTNF | 429 | 86% (48/56) |
| 377 | Pt/POPTR_0012 s01260.1 | 40% (109/274) | 183-238 | FRGVRQRPWGKWAAE IRDPARRVRLWLGTY DTAEEAARVYDNAAI KLRGPDALTNF | 431 | 86% (48/56) |
| 385 | Gm/Glyma11g 02140.1 | 42% (128/307) | 113-168 | FRGVRQRPWGKWAAE IRDPARRVRLWLGTY DTAEEAALVYDNAAI KLRGPHALTNF | 435 | 86% (48/56) |
| 389 | Pt/POPTR_0003 s13610.1 | 43% (137/322) | 127-182 | FRGVRQRPWGKWAAE IRDPLRRVRLWLGTY DTAEEAAMVYDNAAI QLRGADALTNF | 437 | 86% (48/56) |
| 391 | Eg/Eucgr. K00321.1 | 43% (101/239) | 90-145 | FRGVRQRPWGKWAAE IRDPARRVRLWLGTY DTAEEAAMVYDNAAI KLRGPDALTNF | 438 | 86% (48/56) |
| 313 | At/AT4G23750.1 | 51% (177/350) | 122-177 | FRGVRQRPWGKWAAE IRDPLKRVRLWLGTY NTAEEAAMVYDNAAI QLRGPDALTNF | 399 | 84% (47/56) |
| 339 | Os/LOC_Os01g 12440.1 | 41% (111/273) | 150-205 | FRGVRRRPWGKYAAE IRDPWRRVRVWLGTF DTAEEAAKVYDTAAI QLRGRDATTNF | 412 | 84% (47/56) |
| 343 | Zm/GRMZM2G 142179_T01 | 37% (119/329) | 115-170 | FRGVRRRPWGKYAAE IRDPWRRVRVWLGTF DTAEEAAKVYDSAAI QLRGADATTNF | 414 | 84% (47/56) |
| 351 | Zm/GRMZM2G 160971_T01 | 48% (72/152) | 89-144 | FRGVRRRPWGKFAAE IRDPWRGVRVWLGTF DTAEEAARVYDTAAI QLRGANATTNF | 418 | 84% (47/56) |
| 367 | Eg/Eucgr. E00834.1 | 42% (126/303) | 116-171 | FRGVRQRPWGKWAAE IRDPKKGTRVWLGTF GTAEEAALVYDNAAI QLRGPDALTNF | 426 | 84% (47/56) |
| 375 | Eg/Eucgr. A02669.1 | 46% (89/195) | 128-183 | FRGVRQRPWGKWAAE IRDPTRRVRLWLGTY DTAEEAAMVYDNAAL KLRGPDAQTNF | 430 | 84% (47/56) |
| 379 | Pt/POPTR_ 0015s06070.1 | 41% (113/281) | 130-185 | FRGVRQRPWGKWAAE IRDPARRQRLWLGTY DTAEEAARVYDNAAI KLRGPDALTNF | 432 | 84% (47/56) |
| 383 | Eg/Eucgr. D01775.1 | 45% (134/302) | 122-177 | FRGVRRRPWGKWAAE IRDPLRRVRLWLGTY | 434 | 84% (47/56) |

TABLE 6-continued

Conserved AP2 domain of CRF1 and closely related sequences

| Col. 1 SEQ ID NO: | Col. 2 Species/ Identifier | Col. 3 Percent identity of polypeptide in Col. 1 to CRF1 | Col. 4 AP2 domain in amino acid coordinates | Col. 5 Conserved AP2 domain | Col. 6 SEQ ID NO: of AP2 domain | Col. 7 Percent identity of AP2 domain in Col. 5 to AP2 domain of CRF1 |
|---|---|---|---|---|---|---|
| | | | | DTAEEAAMVYDQAAI QLRGPDALTNF | | |
| 393 | Bd/Bradi2g 07357.1 | 35% (115/329) | 124-179 | FRGVRRRPWGKYAAE IRDPWRRVRVWLGTF DTAEEAARVYDSAAI KLRGPDATVNF | 439 | 84% (47/56) |
| 315 | At/AT4G27950.1 | 43% (91/213) | 118-173 | YRGVRQRPWGKWAAE IRDPEQRRRIWLGTF ATAEEAAIVYDNAAI KLRGPDALTNF | 400 | 83% (46/56) |
| 317 | At/AT5G53290.1 | 50% (82/165) | 125-180 | FRGVRQRPWGKWAAE IRDPEQRRRIWLGTF ETAEEAAVVYDNAAI RLRGPDALTNF | 401 | 83% (46/56) |
| 327 | Gm/Glyma13g 08490.1 | 37% (119/322) | 108-163 | FRGVRQRPWGKWAAE IRDPVQRVRIWLGTF LTAFFAALCYDNAAI MLRGPDALTNF | 406 | 83% (46/56) |
| 329 | Gm/Glyma14g 29040.1 | 40% (116/292) | 103-158 | FRGVRQRPWGKWAAE IRDPVQRVRIWLGTF KTAEEAALCYDNAAI TLRGPDALTNF | 407 | 83% (46/56) |
| 349 | Zm/GRMZM2G 151542_T01 | 43% (67/156) | 93-148 | FRGVRRRPWGKFAAE IRDPWRGVRVWLGTF DTAEEAARVYDAAAV QLRGANATTNF | 417 | 83% (46/56) |
| 395 | Bd/Bradi2g 45530.1 | 39% (77/200) | 99-154 | FRGVRRRPWGKYAAE IRDPWRGVRVWLGTF DTAEEAARVYDSAAI QLRGASATTNF | 440 | 83% (46/56) |
| 365 | Cc/clementine 0.9_017304m | 42% (77/185) | 106-161 | YRGVRMRPWGKWAAE IRDPFQRTRVWLGTF ETAEEAALVYDQAAI RLKGPHAQTNF | 425 | 77% (43/56) |
| 371 | Pt/POPTR_0014 s09020.1 | 40% (84/214) | 119-174 | YRGVRQRPWGRWAAE IRDPYRRTRVWLGTY DTAEEAAMVYDQAAI RIKGPDAQTNF | 428 | 77% (43/56) |
| 311 | At/AT3G61630.1 | 48% (82/174) | 105-160 | YRGVRQRPWGKFAAE IRDPSSRTRIWLGTF VTAEEAAIAYDRAAI HLKGPKALTNF | 398 | 77% (43/56) |
| 369 | Pt/POPTR_0002 s16900.1 | 43% (92/215) | 107-162 | YRGVRQRPWGRWAAE IRDPYRRTRLWLGTY DTAEEAAMVYDQAAI RIKGPDAQTNF | 427 | 75% (42/56) |
| 309 | At/AT2G46310.1 | 47% (85/181) | 99-154 | YRGVRQRPWGKFAAE IRDPSSRTRLWLGTF ATAEEAAIGYDRAAI RIKGHNAQTNF | 397 | 75% (42/56) |
| 353 | Os/LOC_Os06g 06540.1 | 36% (90/253) | 121-176 | FRGVRKRPWGKYGAE IRVSQQSARVWLGTF DTAEEAARVYDHAAL RLRGPSATTNF | 419 | 72% (40/56) |

TABLE 6-continued

Conserved AP2 domain of CRF1 and closely related sequences

| Col. 1 SEQ ID NO: | Col. 2 Species/ Identifier | Col. 3 Percent identity of polypeptide in Col. 1 to CRF1 | Col. 4 AP2 domain in amino acid coordinates | Col. 5 Conserved AP2 domain | Col. 6 SEQ ID NO: of AP2 domain | Col. 7 Percent identity of AP2 domain in Col. 5 to AP2 domain of CRF1 |
|---|---|---|---|---|---|---|
| 355 | Zm/GRMZM2G 328197_T01 | 36% (68/191) | 103-158 | YRGVRRRPWGKYAAE IRDPHKGERLWLGTF DTAEEAAREYDSAAR RLRGPSATTNF | 420 | 72% (40/56) |
| 359 | Si/Si008428m | 35% (112/321) | 94-149 | YRGVRRRPWGKYAAE IRDPHKNARVWLGTF DTAEEAARMYDSEAR RLRGPSATTNF | 422 | 72% (40/56) |
| 361 | Zm/GRMZM2G 009598_T01 | 43% (60/141) | 80-135 | FRGVRRRPWGRWAAE IREPHNRRRLWLGTF DTAEEAANAYDAANI RFRGVSATTNF | 423 | 70% (39/56) |
| 357 | Zm/GRMZM2G 429378_T01 | 38% (66/177) | 101-156 | YRGVRRRPWGRYAAE IRDPHKGERLWLGTF DTAEEAARRYDSETR RERGPSAITNE | 421 | 67% (37/56) |
| 363 | Si/Si037209m | 41% (55/137) | 84-139 | FRGVRRRAWGRWAAE IRDPHGSRRIWLGTF NSAEEAAAAYDVANI RFRGASAHTNF | 424 | 65% (36/56) |

Species abbreviations for Table 6:
At—*Arabidopsis haliana*;
Bd—*Brachypodium distachyon*;
Cc—*Citrus clementina*;
Eg—*Eucalyptus grandis*;
Gm—*Glycine max*;
Os—*Oryza sativa*;
Pt—*Populus trichocarpa*;
Si—*Setaria italica*;
Sl—*Solanum lycopersicum*;
Zm—*Zea mays*

Sequences that are functionally-related and/or closely-related to the polypeptides in Table 6 may be created artificially, semi-synthetically, or may occur naturally by having descended from the same ancestral sequence as the disclosed CRF1-related sequences, where the polypeptides have the function of conferring increased photosynthetic resource use efficiency to plants.

As shown in FIG. 8C-8D, these "functionally-related and/or closely-related" CRF1 clade polypeptides generally contain a consensus AP2 domain sequence of the CRF1 clade, SEQ ID NO: 441:

$X^1RGX^6RxRX^2WGX^3X^4X^5AEIRxxxxxxxRX^6WLGTX^1xX^7AEEAAxx$
$YDxxxxxxX^3GxxAxxNF.*$ As shown in FIG. 8A-8B, these "functionally-related and/or closely-related" CRF1 clade polypeptides also generally contain a consensus sequence of SEQ ID NO: 442:

$X^6xX^6xxxDxxxTV^8SSX^9xX^8*$

*In the above consensus sequences of SEQ ID NO: 441-442, x represents any amino acid; $X^1$ can be F or Y; $X^2$ can be P or A; $X^3$ can be R or K; $X^4$ can be W, F or Y; $X^5$ can be A or G; $X^6$ can be I, V, L, or M; $X^7$ can be T or S; $X^8$ can be D or E; and $X^9$ can be G or S.

The presence of one or more of these consensus sequences and/or these amino acid residues is correlated with conferring of improved or increased photosynthetic resource use efficiency to a plant when the expression level of the polypeptide is altered in a plant by being reduced, knocked-out, or overexpressed. A CRF1 clade polypeptide sequence that is "functionally-related and/or closely-related" to the listed full length protein sequences or domains provided in Table 6 may also have at least 35%, 36%, 37%, 38%, 39%, 40%, 41%, 42%, 43%, 44%, 45%, 46%, 47%, 48%, 49%, 50%, 51%, 52%, 61%, or about 100% amino acid identity to SEQ ID NO: 307 or to the amino acid sequence of SEQ ID NO: 307, where n=1-45, and/or at least 65%, 67%, 70%, 72%, 75%, 77%, 83%, 84%, 86%, 88%, 90% or about 100% amino acid identity to the AP2 domain of SEQ ID NO: 307 or SEQ ID NO: 396-440. The presence of the disclosed conserved AP2 domains in the polypeptide sequence (for example, SEQ ID NO: 396-440), is correlated with the conferring of improved or increased photosynthetic resource use efficiency to a plant when the expression level of the polypeptide is altered in a plant by being reduced, knocked-out, or overexpressed. All of the sequences that adhere to these functional and sequential relationships are herein referred to as "CRF1 clade polypeptides" or "G1421 clade polypeptides", or which fall within the "CRF1 clade" or "G1421 clade" exemplified in the phylogenetic tree in FIG. 7 as those polypeptides bounded by Bradi2g07357.1 and Solyc08g081960.1.1 (indicated by the box around these sequences).

TABLE 7

Conserved 'AP2 domain' of ERF058 and closely related sequences

| Col. 1 SEQ ID NO: | Col. 2 Species/ Identifier | Col. 3 Percent identity of polypeptide in Col. 1 to ERF058 | Col. 4 Amino acids spanning AP2 domain | Col. 5 Conserved AP2 domain | Col. 6 SEQ ID NO: of AP2 domain | Col. 7 Percent identity of AP2 domain in Col. 5 to AP2 domain of ERF058 |
|---|---|---|---|---|---|---|
| 490 | At/ERF058 or AT1G22190.1 | 100% (261/261) | 82-145 | LYRGVRQRHWGKWVA EIRLPRNRTRLWLGT FDTAEEAALAYDKAA YKLRGDFARLNFPDL RHND | 549 | 100% (64/64) |
| 492 | At/AT1G78080.1 | 53% (177/338) | 151-213 | LYRGVRQRHWGKWVA EIRLPRNRTRLWLGT FDTAEEAALAYDKAA YKLRGDFARLNFPNL RHN | 550 | 98% (62/63) |
| 516 | Gm/Glyma04g 11290.1 | 48% (154/323) | 138-199 | LYRGVRQRHWGKWVA EIRLPKNRTRLWLGT FDTAEEAALAYDKAA YKLRGDFARLNFPNL RH | 562 | 96% (60/62) |
| 518 | Gm/Glyma06g 11010.1 | 49% (149/308) | 127-188 | LYRGVRQRHWGKWVA EIRLPKNRTRLWLGT FDTAEEAALAYDKAA YKLRGDFARLNFPNL RH | 563 | 96% (60/62) |
| 522 | Pt/POPTR_0005 s16690.1 | 63% (126/201) | 171-233 | LYRGVRQRHWGKWVA EIRLPKNRTRLWLGT FDTAEEAALAYDKAA YKLRGDFARLNFPNL RHQ | 565 | 96% (60/62) |
| 524 | Vv/GSVIVT010 09007001 | 60% (121/204) | 112-174 | LYRGVRQRHWGKWVA EIRLPKNRTRLWLGT FDTAEEAALAYDKAA YKLRGDFARLNFPNL RHQ | 566 | 96% (60/62) |
| 498 | Sl/Solyc04g 054910.2.1 | 45% (132/294) | 76-141 | LYRGVRQRHWGKWVA EIRLPKNRTRLWLGT FDTAEEAALAYDKAA YKLRGEFARLNFPHL RHQLNN | 553 | 95% (59/62) |
| 502 | Pt/POPTR_0007 s05690.1 | 47% (132/284) | 176-237 | LYRGVRQRHWGKWVA EIRLPKNRTRLWLGT FDTAEEAALAYDKAA YKLRGEFARLNFPHL RH | 555 | 95% (59/62) |
| 526 | Sl/Solyc12g 056980.1.1 | 48% (150/316) | 124-186 | LYRGVRQRHWGKWVA EIRLPKNRTRLWLGT FDTAEEAALAYDKAA YKLRGEFARLNFPHL RHN | 567 | 95% (60/63) |
| 528 | Bd/Bradi4g 29010.1 | 45% (126/282) | 109-168 | LYRGVRQRHWGKWVA EIRLPRNRTRLWLGT FDTAEEAALAYDQAA YRLRGDAARLNFPDN | 568 | 94% (56/59) |

TABLE 7-continued

Conserved 'AP2 domain' of ERF058 and closely related sequences

| Col. 1 SEQ ID NO: | Col. 2 Species/ Identifier | Col. 3 Percent identity of polypeptide in Col. 1 to ERF058 | Col. 4 Amino acids spanning AP2 domain | Col. 5 Conserved AP2 domain | Col. 6 SEQ ID NO: of AP2 domain | Col. 7 Percent identity of AP2 domain in Col. 5 to AP2 domain of ERF058 |
|---|---|---|---|---|---|---|
| 504 | Vv/GSVIVT010 02262001 | 50% (138/281) | 94-155 | LYRGVRQRHWGKWVA EIRLPKNRTRLWLGT FDTAEEAALAYDKAA FKLRGEFARLNFPNL RH | 556 | 93% (58/62) |
| 514 | Gm/Glyma14g 34590.1 | 44% (140/324) | 150-216 | LYRGVRQRHWGKWVA EIRLPKNRTRLWLGT FDTAEEAALAYDKAA YRLRGDFARLNFPSL KGSCPGE | 561 | 93% (57/61) |
| 520 | Pt/POPTR_0002 s09480.1 | 62% (125/203) | 162-224 | LYRGVRQRHWGKWVA EIRLPKNRTRLWLGT FDTAEEAALAYDRAA YKLRGDFARLNFPNL LHQ | 564 | 93% (58/62) |
| 530 | Os/LOC_Os08g 31580.1 | 52% (101/197) | 103-162 | LYRGVRQRHWGKWVA EIRLPRNRTRLWLGT FDTAEEAALTYDQAA YRLRGDAARLNFPDN | 569 | 93% (55/59) |
| 510 | Gm/Glyma13g 01930.1 | 47% (147/317) | 137-203 | LYRGVRQRHWGKWVA EIRLPKNRTRLWLGT FDTAEEAALAYDKAA YRLRGDLARLNFPNL KGSCPGE | 559 | 91% (56/61) |
| 546 | Zm/GRMZM2G 113060_T01 | 46% (100/219) | 113-173 | LYRGVRQRHWGKWVA EIRLPRNRTRLWLGT FDTAEEAALAYDGAA FRLRGDSARLNFPEL R | 577 | 91% (56/61) |
| 500 | Pt/POPTR_0005 s07900.1 | 53% (118/226) | 172-233 | LYRGVRQRHWGKWVA EIRLPKNRTRLWLGT YDTAEEAALAYDNAA YKLRGEYARLNFPHL RH | 554 | 90% (56/62) |
| 506 | Gm/Glyma05g 31370.1 | 45% (141/314) | 116-178 | LYRGVRQRHWGKWVA EIRLPKNRTRLWLGT FDTAEEAALAYDNAA FKLRGEFARLNFPHL RHH | 557 | 90% (57/63) |
| 508 | Gm/Glyma08g 14600.1 | 45% (142/318) | 120-182 | LYRGVRQRHWGKWVA EIRLPKNRTRLWLGT FDTAEEAALAYDNAA FKLRGEFARLNFPHL RHH | 558 | 90% (57/63) |
| 534 | Si/Si017760m | 54% (107/201) | 161-221 | LYRGVRQRHWGKWVA EIRLPKNRTRLWLGT FDTAEDAALAYDKAA FRLRGDMARLNFPAL R | 571 | 90% (55/61) |
| 536 | Os/LOC_Os02g 51670.1 | 53% (109/209) | 168-228 | LYRGVRQRHWGKWVA EIRLPKNRTRLWLGT FDTAEDAALAYDKAA FRLRGDLARLNFPTL R | 572 | 90% (55/61) |

TABLE 7-continued

Conserved 'AP2 domain' of ERF058 and closely related sequences

| Col. 1 SEQ ID NO: | Col. 2 Species/ Identifier | Col. 3 Percent identity of polypeptide in Col. 1 to ERF058 | Col. 4 Amino acids spanning AP2 domain | Col. 5 Conserved AP2 domain | Col. 6 SEQ ID NO: of AP2 domain | Col. 7 Percent identity of AP2 domain in Col. 5 to AP2 domain of ERF058 |
|---|---|---|---|---|---|---|
| 540 | Zm/GRMZM5G 852704_T01 | 54% (108/200) | 173-233 | LYRGVRQRHWGKWVA EIRLPRNRTRLWLGT FDSAEDAALAYDKAA FRLRGDAARLNFPSL R | 574 | 90% (55/61) |
| 544 | Os/LOC_Os03g 09170.1 | 50% (104/211) | 111-171 | LYRGVRQRHWGKWVA EIRLPRNRTRLWLGT FDTAEEAALAYDSAA FRLRGESARLNFPEL R | 576 | 90% (55/61) |
| 548 | At/AT4G39780 | 43% (120/282) | 92-155 | LYRGVRQRHWGKWVA EIRLPKNRTRLWLGT FDTAEEAAMAYDLAA YKLRGEFARLNFPQF RHED | 578 | 89% (57/64) |
| 512 | Gm/Glyma18g 02170.1 | 43% (130/306) | 122-184 | LYRGVRQRHWGKWVA EIRLPKNRTRLWLGT FDTAEEAALAYDNAA FKLRGENARLNFPHL RHH | 560 | 88% (56/63) |
| 532 | Zm/GRMZM2G 029323_T01 | 54% (106/199) | 147-207 | LYRGVRQRHWGKWVA EIRLPKNRTRLWLGT FDTAEGAALAYDEAA FRLRGDTARLNFPSL R | 570 | 88% (54/61) |
| 538 | Bd/Bradi3g 58980.1 | 52% (93/182) | 155-215 | LYRGVRQRHWGKWVA EIRLPKNRTRLWLGT FDAAEDAALAYDKAA FRLRGDQARLNFPAL R | 573 | 88% (54/61) |
| 542 | Si/Si008385m | 54% (108/200) | 173-233 | LYRGVRQRHWGKWVA EIRLPRNRTRLWLGT FGSAEDAALAYDKAA FRLRGDAARLNFPSL R | 575 | 88% (54/61) |
| 496 | At/AT5G65130.1 | 50% (99/201) | 110-169 | LYRGVRQRQWGKWVA EIRLPKNRTRLWLGT FETAQEAALAYDQAA HKIRGDNARLNFPDI | 552 | 85% (51/60) |
| 494 | At/AT2G22200.1 | 48% (101/214) | 70-133 | LYRGVRQRHWGKWVA EIRLPKNRTRLWLGT FETAEKAALAYDQAA FQLRGDIAKLNFPNL IHED | 551 | 82% (53/64) |

Species abbreviations for Table 7:
At—*Arabidopsis thaliana*;
Bd—*Brachypodium distachyon*;
Gm—*Glycine max*;
Os—*Oryza sativa*;
Pt—*Populus trichocarpa*;
Si—*Setaria italica*;
Sl—*Solanum lycopersicum*;
Vv—*Vitis vinifera*;
Zm—*Zea mays*

Sequences that are functionally-related and/or closely-related to the polypeptides in Table 7 may be created artificially, semi-synthetically, or may occur naturally by having descended from the same ancestral sequence as the disclosed ERF058-related sequences, where the polypeptides have the function of conferring increased photosynthetic resource use efficiency to plants.

Several consensus sequences may be used to identify members of the ERF058 clade of polypeptide, which are sequences that are expected to function as indicated in the embodiments of this specification provided below. As shown in FIG. 11D-11E, these functionally-related and/or closely-related ERF058 clade polypeptides generally contain a consensus sequence of the ERF058 clade, SEQ ID NO: 579 (which is found in boldface in FIG. 11D-11E).

LYRGVRQRX$^1$WGKWVAEIRLPX$^2$NRTRLWLGTX$^3$xX$^4$AX$^5$xAAX$^6$X$^7$

YDxAAxX$^8$X$^6$RGX$^9$xAX$^2$LNFP;

wherein x represents any amino acid; X$^1$ is Q or H; X$^2$ is K or R; X$^3$ is F or Y; X$^4$ is A, S or T; X$^5$ is Q or E; X$^6$ is M, I, L, or V; X$^7$ is A or T; X$^8$ is K, Q or R; and X$^9$ is E or D.

As shown in FIG. 11E-11F, these functionally-related and/or closely-related ERF058 clade polypeptides also generally contain a ERF058 clade consensus sequence SEQ ID NO: 580:

X$^6$xxX$^{10}$X$^6$X$^{11}$X$^4$KX$^6$xxX$^6$C;

wherein x represents any amino acid; X$^4$ is A, S or T; X$^6$ is M, I, L, or V; X$^{10}$ is A or S; and X$^{11}$ is N or D.

There is also a small motif in FIG. 11G-11H that is present in ERF058 clade member proteins, and is identifiable as SEQ ID NO: 581:

LxxxPSxX$^9$IX$^{12}$x$^{11}$WxX$^{10}$X$^6$.

wherein x represents any amino acid; X$^6$ is M, I, L, or V; X$^9$ is E or D; X$^{10}$ is A or S; and X$^{11}$ is N or D; and X$^{12}$ is F or absent.

The presence of one or more of these consensus sequences and/or these amino acid residues is correlated with conferring of improved or increased photosynthetic resource use efficiency to a plant when the expression level of the polypeptide is altered in a plant by being reduced, knocked-out, or overexpressed. An ERF058 clade polypeptide sequence that is "functionally-related and/or closely-related" to the listed full length protein sequences or domains provided in Table 7 may also have at least 43%, 44%, 45%, 46%, 47%, 48%, 49%, 50%, 52%, 53%, 54%, 60%, 62%, 63%, or about 100% amino acid identity to SEQ ID NO: 490 or to the entire length of a listed sequence, or to the amino acid sequence of SEQ ID NO: 492, 494, 496, 498, 500, 502, 504, 506, 508, 510, 512, 514, 516, 518, 520, 522, 524, 526, 528, 530, 532, 534, 536, 538, 540, 542, 544, 546, 548, and/or at least 82%, 83%, 84%, 85%, 86%, 87%, 88%, 89%, 90%, 91%, 92%, 93%, 94%, 95%, 96%, 97%, 98%, 99%, or about 100% amino acid identity to the AP2 domain of SEQ ID NO: 490 or to SEQ ID NO: 549-581. The presence of the disclosed conserved AP2 domain in the polypeptide sequence (for example, SEQ ID NO: 549-578), or a clade consensus sequence of SEQ ID NO: 579, 580, or 581, is correlated with the conferring of improved or increased photosynthetic resource use efficiency to a plant when the expression level of the polypeptide is altered in a plant by being reduced, knocked-out, or overexpressed. All of the sequences that adhere to these functional and sequential relationships are herein referred to as "ERF058 clade polypeptides" or "ERF058 clade polypeptides", or which fall within the "ERF058 clade" or "G974 clade" exemplified in the phylogenetic tree in FIG. 10 as those polypeptides bounded by Bradi4g29010.1 and POPTR_0005 s16690.1 (indicated by the box around these sequences).

TABLE 8

Conserved HLH domain of SPATULA and closely related sequences

| Col. 1 SEQ ID NO: | Col. 2 Species/ Identifier | Col. 3 Percent identity of polypeptide in Col. 1 to SPATULA | Col. 4 HLH domain in amino acid coordinates | Col. 5 Conserved HLH domain | Col. 6 SEQ ID NO: of HLH domain | Col. 7 Percent identity of the HLH domain in Col. 5 to the HLH domain of SPATULA |
|---|---|---|---|---|---|---|
| 625 | At/SPATULA or AT4G36930 | 100% (373/373) | 195-251 | RCRAAEVHNLSEKRR RSRINEKMKALQSLI PNSNKTDKASMLDEA IEYLKQLQLQVQ | 666 | 100% (57/57) |
| 627 | Bd/Bradi1g 48400.1 | 83% (70/84) | 104-160 | RTRAAEVHNLSEKRR RSRINEKMKALQSLI PNSNKTDKASMLDEA IEYLKQLQLQVQ | 667 | 98% (56/57) |
| 629 | Gm/Glyma01g 39450.1 | 51% (127/245) | 139-195 | RSRAAEVHNLSEKRR RSRINEKMKALQNLI PNSNKTDKASMLDEA IEYLKQLQLQVQ | 668 | 98% (54/55) |
| 631 | Pt/POPTR_0014 s02590.1 | 50% (103/203) | 121-177 | RSRAAEVHNLSEKRR RSRINEKMKALQNLI PNSNKTDKASMLDEA IEYLKQLQLQVQ | 669 | 98% (54/55) |

TABLE 8-continued

Conserved HLH domain of SPATULA and closely related sequences

| Col. 1 SEQ ID NO: | Col. 2 Species/ Identifier | Col. 3 Percent identity of polypeptide in Col. 1 to SPATULA | Col. 4 HLH domain in amino acid coordinates | Col. 5 Conserved HLH domain | Col. 6 SEQ ID NO: of HLH domain | Col. 7 Percent identity of the HLH domain in Col. 5 to the HLH domain of SPATULA |
|---|---|---|---|---|---|---|
| 633 | Sl/Solyc02g 093280.2.1 | 50% (104/204) | 140-196 | RSRAAEVHNLSEKRR RSRINEKMKALQKLI PNSNKTDKASMLDEA IEYLKQLQLQVQ | 670 | 98% (54/55) |
| 635 | Eg/Eucgr. I00906.1 | 60% (91/151) | 22-78 | RSRTAEVHNLSEKRR RSRINEKMKALQSLI PNSNKTDKASMLDEA IEYLKQLQLQVQ | 671 | 98% (54/55) |
| 637 | Vv/GSVIVT010 22111001 | 54% (119/217) | 137-193 | RSRAAEVHNLSEKRR RSRINEKMKALQNLI PNSNKTDKASMLDEA IEYLKQLQLQVQ | 672 | 98% (54/55) |
| 639 | Vv/GSVIVT010 09467001 | 52% (113/214) | 185-241 | RSRAAEVHNLSEKRR RSRINEKMKALQNLI PNSNKTDKASMLDEA IEYLKQLQLQVQ | 673 | 98% (54/55) |
| 641 | Cc/clementine 0.9_029807m | 54% (103/188) | 157-213 | RSRAAEVHNLSEKRR RSRINEKMKALQSLI PNSNKTDKASMLDEA IEYLKHLQLQVQ | 674 | 98% (54/55) |
| 643 | Os/LOC_Os06g 06900.1 | 68% (77/113) | 101-157 | RSRAAEVHNLSEKRR RSKINEKMKALQSLI PNSNKTDKASMLDEA IEYLKQLQLQVQ | 675 | 98% (54/55) |
| 645 | Zm/GRMZM2G 017349_T01 | 82% (69/84) | 103-159 | RSRAAEVHNLSEKRR RSKINEKMKALQSLI PNSNKTDKASMLDEA IEYLKQLQLQVQ | 676 | 98% (54/55) |
| 647 | Gm/Glyma11g 05810.1 | 41% (144/348) | 138-194 | RSRAAEVHNLSEKRR RGRINEKMKALQNLI PNSNKTDKASMLDEA IEYLKQLQLQVQ | 677 | 96% (53/55) |
| 649 | Cc/clementine 0.9_017382m | 54% (93/170) | 104-160 | RSRAAEVHNLSEKRR RSRINEKLKALQNLI PNSNKTDKASMLDEA IEYLKQLQLQVQ | 678 | 96% (53/55) |
| 651 | Cc/clementine 0.9_017468m | 54% (93/170) | 103-159 | RSRAAEVHNLSEKRR RSRINEKLKALQNLI PNSNKTDKASMLDEA IEYLKQLQLQVQ | 679 | 96% (53/55) |
| 653 | Os/LOC_Os02g 56140.1 | 83% (64/77) | 52-108 | RSRAAEVHNLSEKRR RSRINEKMKALQSLI PNSSKTDKASMLDDA IEYLKQLQLQVQ | 680 | 96% (53/55) |
| 655 | Sl/Solyc04g 078690.2.1 | 48% (84/175) | 132-188 | RSRSAEVHNLSEKRR RSRINEKLKALQNLI PNSNKTDKASMLDEA IEYLKQLQLQVQ | 681 | 94% (52/55) |
| 657 | Gm/Glyma17g 19500.1 | 79% (66/83) | 19-75 | RNRAAEVHNLSEKRR RSRINEKLKALQNLI PNSNKTDKASMLDEA IEYLKQLHLKVQ | 682 | 92% (51/55) |

TABLE 8-continued

Conserved HLH domain of SPATULA and closely related sequences

| Col. 1 SEQ ID NO: | Col. 2 Species/ Identifier | Col. 3 Percent identity of polypeptide in Col. 1 to SPATULA | Col. 4 HLH domain in amino acid coordinates | Col. 5 Conserved HLH domain | Col. 6 SEQ ID NO: of HLH domain | Col. 7 Percent identity of the HLH domain in Col. 5 to the HLH domain of SPATULA |
|---|---|---|---|---|---|---|
| 659 | Pt/POPTR_0005 s18280.1 | 73% (72/98) | 134-190 | RTRAAEVHNLSEKRR RSRINEKMKALQNLI PNSSKTDKASMLDEA IEYLKLLQLQVQ | 683 | 92% (52/56) |
| 661 | Zm/GRMZM2G 030744_T02 | 79% (65/82) | 43-99 | RSRAAEVHNLSEKRR RSRINEKMKALQTLI PNSSKTDKASMLDDA IEYLKHLQLQVQ | 684 | 92% (51/55) |
| 663 | Zm/GRMZM2G 030744_T03 | 79% (65/82) | 43-99 | RSRAAEVHNLSEKRR RSRINEKMKALQTLI PNSSKTDKASMLDDA IEYLKHLQLQVQ | 685 | 92% (51/55) |
| 665 | At/AT5G67110.1 | 79% (55/69) | 91-147 | RNIDAQFHNLSEKKR RSKINEKMKALQKLI PNSNKTDKASMLDEA IEYLKQLQLQVQ | 686 | 90% (48/53) |

Species abbreviations for Table 8:
At—Arabidopsis thaliana;
Bd—Brachypodium distachyon;
Cc—Citrus clementina;
Eg—Eucalyptus grandis;
Gm—Glycine max;
Os—Oryza sativa;
Pt—Populus trichocarpa;
Si—Setaria italica;
Sl—Solanum lycopersicum;
Vv—Vitis vinifera;
Zm—Zea mays Sequences that are functionally-related and/or closely-related to the polypeptides in Table 8 may be created artificially, semi-synthetically, or may occur naturally by having descended from the same ancestral sequence as the disclosed SPATULA-related sequences, where the polypeptides have the function of conferring increased photosynthetic resource use efficiency to plants.

As shown in FIG. 14H-FIG. 14I, these "functionally-related and/or closely-related" SPATULA clade polypeptides generally contain a consensus sequence of the SPATULA clade, SEQ ID NO: 687:

KRxxxAX$^1$xHNLSEKX$^2$RRX$^3$X$^2$INEKX$^4$KALQxLIPNSxKTDKASM

LDX$^5$AIEYLKxLX$^6$LX$^7$VQxX$^8$X$^9$X$^8$. *

*In the above consensus sequence of SEQ ID NO: 687, x represents any amino acid;

X$^1$ is E or Q; X$^2$ is R or K; X$^3$ is G or S; X$^4$ is I, V, L, or M; X$^5$ is E or D; X$^6$ is Q or H; X$^7$ is Q or K; X$^8$ is I, V, L, M, or absent; and X$^9$ is S, T, A, or absent. Alternative consensus sequences comprising the above with conservative substitutions found in Table 1 are also envisaged and may be expected to provide equivalent function(s).

The presence of one or more of these consensus sequences and/or these amino acid residues is correlated with conferring of improved or increased photosynthetic resource use efficiency to a plant when the expression level of the polypeptide is altered in a plant by being reduced, knocked-out, or overexpressed. A SPATULA clade polypeptide sequence that is "functionally-related and/or closely-related" to the listed full length protein sequences or domains provided in Table 8 may also have at least 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% amino acid identity to SEQ ID NO: 625, and/or at least 90%, 91%, 92%, 93%, 94%, 95%, 96%, 97%, 98%, 99%, or about 100% amino acid identity to the HLH domain of SEQ ID NO: 625, in its amino acid sequence to the entire length of a listed sequence or to a listed domain, or to the amino acid sequence of SEQ ID NO: 625, 627, 629, 631, 633, 635, 637, 639, 641, 643, 645, 647, 649, 651, 653, 655, 657, 659, 661, 663, 665, 666, 667, 668, 669, 670, 671, 672, 673, 674, 675, 676, 677, 678, 679, 680, 681, 682, 683, 684, 685, or 686. The presence of the disclosed conserved HLH domain and/or other domains in the polypeptide sequence (for example, in any of SEQ ID NO: 666-686), is correlated with the conferring of improved or increased photosynthetic resource use efficiency to a plant when the expression level of the polypeptide is altered in a plant by being reduced, knocked-out, or overexpressed. All of the sequences that adhere to these functional and sequential relationships are herein referred to as "SPATULA clade polypeptides" or "SPATULA clade polypeptides", or which fall within the "SPATULA clade" or "G590 clade" exemplified in the phylogenetic tree in FIG. 13 as those polypeptides bounded by Bradi1g48400.1_BRADI and Solyc04g078690.2.1_SOLLY (indicated by the box with the dashed border around these sequences).

TABLE 9

MYB111 Glade sequences and conserved first SANT domains of MYB111 and closely related sequences

| Col. 1 SEQ ID NO: | Col. 2 Species/ Identifier | Col. 3 Percent identity of polypeptide in Col. 1 to MYB111 | Col. 4 SANT domain 1 in amino acid coordinates | Col. 5 Conserved SANT domain 1 | Col. 6 SEQ ID NO: of SANT domain 1 | Col. 7 Percent identity of first SANT domain in Col. 5 to SANT domain 1 of MYB111 |
|---|---|---|---|---|---|---|
| 735 | At/MYB111 AT5G49330 | 100% (342/342) | 14-63 | RGRWTAEEDEILTKY IQTNGEGSWRSLPKK AGLLRCGKSCRLRWI NYLRR | 784 | 50/50 (100%) |
| 741 | Gm/Glyma02g 01740.1 | 57% (125/219) | 14-63 | KGRWTAEEDEILAKY IQANGEGSWRSLPKN AGLLRCGKSCRLRWI NYLRA | 790 | 91% (45/49) |
| 749 | Pp/POPTR_ 0014s11780.1 | 73% (107/146) | 14-63 | KGRWTAEEDEKLTKY IQANGEGSWRSLPKN AGLLRCGKSCRLRWI NYLAA | 798 | 91% (44/48) |
| 745 | Gm/Glyma19g 40250.1 | 81% (97/119) | 14-63 | KGRWTTEEDEILTKY IMANGEGSWRSLPKN AGLLRCGKSCRLRWI NYLRA | 794 | 89% (44/49) |
| 753 | Sl/Solyc01g 079620.2.1 | 75% (103/137) | 14-63 | RGRWTAEEDQILTNY IISNGEGSWRSLPKN AGLLRCGKSCRLRWI NYLRS | 802 | 89% (44/49) |
| 755 | Sl/Solyc06g 009710.2.1 | 82% (103/125) | 14-63 | RGRWTSEEDEILTNY IQANGEGSWRSLPKN AGLLRCGKSCRLRWI NYLKS | 804 | 89% (44/49) |
| 761 | Gm/Glyma17g 03480.1 | 55% (128/231) | 14-63 | KGRWTAEEDKILTDY QIENGEGSWRSLPKN AGLLRCGKSCRLRWI NYLRS | 810 | 89% (44/49) |
| 737 | At/AT2G47460.1 | 61% (120/194) | 14-63 | RGRWTAEEDQILSNY IQANGEGSWRSLPKN AGLKRCGKSCRLRWI NYLRS | 786 | 87% (43/49) |
| 747 | Pp/POPTR_ 0002s19920.1 | 58% (118/203) | 14-63 | KGRWTAEEDEKLAKY IQANGEGSWRSMPKN AGLLRCGKSCRLRWI NYLRA | 796 | 87% (43/49) |
| 751 | Pp/POPTR_ 0010s15090.1 | 42% (160/377) | 14-63 | KGRWTAEEDEVLTKY ILANGEGSWKSLPKN AGLLRCGKSCRLRWI NYLRA | 800 | 87% (43/49) |
| 759 | Gm/Glyma07g 37140.1 | 56% (121/215) | 14-63 | KGRWTAEEDKILTDY IQENGEGSWSSLPKN AGLLRCGKSCRLRWI NYLRS | 808 | 87% (43/49) |

TABLE 9-continued

MYB111 Clade sequences and conserved first SANT
domains of MYB111 and closely related sequences

| Col. 1 SEQ ID NO: | Col. 2 Species/ Identifier | Col. 3 Percent identity of polypeptide in Col. 1 to MYB111 | Col. 4 SANT domain 1 in amino acid coordinates | Col. 5 Conserved SANT domain 1 | Col. 6 SEQ ID NO: of SANT domain 1 | Col. 7 Percent identity of first SANT domain in Col. 5 to SANT domain 1 of MYB111 |
|---|---|---|---|---|---|---|
| 783 | Si/Si039538m | 81% (97/119) | 14-63 | RGRWTAEEDEILANY IAKHGEGSWRSLPKN AGLLRCGKSCRLRWI NYLRA | 832 | 87% (43/49) |
| 743 | Gm/Glyma03g 37640.1 | 43% (143/332) | 14-63 | KGRWTEEEDDILTKY IQANGEGSWRSLPTN SGLLRCGKSCRLRWI NYLRA | 792 | 85% (42/49) |
| 757 | Sl/Solyc12g 049350.1.1 | 76% (94/123) | 14-63 | RGRWTIEEDERLTNY IQANGEGSWRTLPKN AGLLRCGKSCRLRWI NYLKS | 806 | 85% (42/49) |
| 763 | Gm/Glyma09g 04370.1 | 43% (150/345) | 14-63 | KGRWTAEEDKILTDY IQENGEGSWKILPKN AGLLRCGKSCRLRWI NYLRA | 812 | 85% (42/49) |
| 765 | Gm/Glyma15g 15400.1 | 83% (99/119) | 14-63 | KGRWTAEEDKILTDY IQENGEGSWKTLPKN AGLLRCGKSCRLRWI NYLRA | 814 | 85% (42/49) |
| 739 | At/AT3G62610.1 | 55% (106/190) | 14-63 | KGRWTAEEDRTLSDY IQSNGEGSWRSLPKN AGLKRCGKSCRLRWI NYLRS | 788 | 83% (41/49) |
| 771 | Zm/GRMZM2G 051528_T01 | 79% (94/118) | 14-63 | KGRWTREEDEILARY IEEHGEGSWRSLPKN AGLLRCGKSCRLRWI NYLRA | 820 | 83% (41/49) |
| 773 | Si/Si002107m | 81% (97/119) | 14-63 | KGRWTKEEDEILGRY IKEHGEGSWRSLPKN AGLLRCGKSCRLRWI NYLRA | 822 | 83% (41/49) |
| 775 | Os/LOC_Os03g 19120.1 | 64% (94/146) | 14-63 | RGRWTTEEDEKLAGY IAKHGEGSWRSLPKN AGLLRCGKSCRLRWI NYLRA | 824 | 83% (41/49) |
| 777 | Zm/GRMZM2G 022686_T01 | 61% (106/173) | 14-63 | RGRWTKEEDQHANYI AEHGEGSWRSLPKNA GLLRCGKSCRLRWIN YLRA | 826 | 83% (41/49) |
| 779 | Zm/GRMZM2G 057027_T02 | 80% (96/119) | 14-63 | RGRWTAEEDQLLANY IAEHGEGSWRSLPKN AGLLRCGKSCRLRWI NYLRA | 828 | 83% (41/49) |
| 781 | Zm/GRMZM2G 084799_T01 | 61% (105/172) | 14-63 | RGRWTAEEDQLLANY IAEHGEGSWRSLPKN AGLLRCGKSCRLRWI NYLRA | 830 | 83% (41/49) |
| 767 | Os/LOC_Os01g 19970.1 | 52% (124/237) | 14-63 | RGRWTKEEDEKLARY IRENGEGAWRSMPKN AGLLRCGKSCRLRWI NYLRA | 816 | 81% (40/49) |

TABLE 9-continued

MYB111 Glade sequences and conserved first SANT
domains of MYB111 and closely related sequences

| Col. 1 SEQ ID NO: | Col. 2 Species/ Identifier | Col. 3 Percent identity of polypeptide in Col. 1 to MYB111 | Col. 4 SANT domain 1 in amino acid coordinates | Col. 5 Conserved SANT domain 1 | Col. 6 SEQ ID NO: of SANT domain 1 | Col. 7 Percent identity of first SANT domain in Col. 5 to SANT domain 1 of MYB111 |
|---|---|---|---|---|---|---|
| 769 | Zm/GRMZM2G 051256_T01 | 78% (94/119) | 14-63 | KGRWTKEEDEVLARY IKEHGEGSWRSLPKN AGLLRCGKSCRLRWI NYLRA | 818 | 81% (40/49) |

TABLE 10

MYB111 Glade sequences and conserved second SANT
domains of MYB111 and closely related sequences

| Col. 1 SEQ ID NO: | Col. 2 Species/ Identifier | Col. 3 Percent identity of polypeptide in Col. 1 to MYB111 | Col. 4 SANT domain 2 in amino acid coordinates | Col. 5 Conserved SANT domain 2 | Col. 6 SEQ ID NO: of SANT domain 2 | Col. 7 Percent identity of second SANT domain in Col. 5 to SANT domain 2 of MYB111 |
|---|---|---|---|---|---|---|
| 735 | At/ MYB111 AT5G49330 | 100% (342/342) | 67-114 | RGNITSDEEEIIVKL HSLLGNRWSLIATHL PGRTDNEIKNYWNSH LSR | 785 | 48/48 (100%) |
| 737 | At/AT2G47460.1 | 61% (120/194) | 67-114 | RGNITPEEEELVVKL HSTLGNRWSLIAGHL PGRTDNEIKNYWNSH LSR | 787 | 87% (42/48) |
| 753 | Sl/Solyc01g 079620.2.1 | 75% (103/137) | 67-114 | RGNITSQEEDIIIKL HATLGNRWSLIAEHL SGRTDNEIKNYWNSH LSR | 803 | 85% (41/48) |
| 755 | Sl/Solyc06g 009710.2.1 | 82% (103/125) | 67-114 | RGNITSDEEAIIIKL RATLGNRWSLIAEHL PGRTDNEIKNYWNSH LRR | 805 | 85% (41/48) |
| 759 | Gm/Glyma07g 37140.1 | 56% (121/215) | 67-114 | RGNITPQEEEIIVKL HAVLGNRWSVIAGHL PGRTDNEIKNYWNSH LRR | 809 | 85% (41/48) |
| 761 | Gm/Glyma17g 03480.1 | 55% (128/231) | 67-114 | RGNITPQEEEIIVKL HAVLGNRWSVIAGHL PGRTDNEIKNYWNSH LRR | 811 | 85% (41/48) |
| 763 | Gm/Glyma09g 04370.1 | 43% (150/345) | 67-114 | RGNITPEEEEIIVKL HAVLGNRWSVIAGHL PGRTDNEIKNYWNSH LRR | 813 | 85% (41/48) |
| 747 | Pp/POPTR_ 0002s19920.1 | 58% (118/203) | 67-114 | RGNISTEEEEIIVQL HASLGNRWSLIASYL PGRTDNEIKNYWNSH LSR | 797 | 83% (40/48) |

TABLE 10-continued

MYB111 Glade sequences and conserved second SANT
domains of MYB111 and closely related sequences

| Col. 1 SEQ ID NO: | Col. 2 Species/ Identifier | Col. 3 Percent identity of polypeptide in Col. 1 to MYB111 | Col. 4 SANT domain 2 in amino acid coordinates | Col. 5 Conserved SANT domain 2 | Col. 6 SEQ ID NO: of SANT domain 2 | Col. 7 Percent identity of second SANT domain in Col. 5 to SANT domain 2 of MYB111 |
|---|---|---|---|---|---|---|
| 749 | Pp/POPTR_0014s11780.1 | 73% (107/146) | 67-114 | RGNISAEEEEIIINL HASLGNRWSLIASHL PGRTDNEIKNYWNSH LSR | 799 | 83% (40/48) |
| 751 | Pp/POPTR_0010s15090.1 | 42% (160/377) | 67-114 | RGNITKEEEETIVKL HTALGNRWSFIAAQL PGRTDNEIKNYWNSH LSR | 801 | 83% (40/48) |
| 765 | Gm/Glyma15g15400.1 | 83% (99/119) | 67-114 | RGNITPEEEEIIVKL HAVLGNRWSVIAGRL PGRTDNEIKNYWNSH LRR | 815 | 83% (40/48) |
| 773 | Si/Si002107m | 81% (97/119) | 67-114 | RGNISEEEEEMIIKL HATLGNRWSLIAGHL PGRTDNEIKNYWNSH LSR | 823 | 83% (40/48) |
| 779 | Zm/GRMZM2G057027_T02 | 80% (96/119) | 67-114 | RGNISKEEEDIIIKL HATLGNRWSLIASHL PGRTDNEIKNYWNSH LSR | 829 | 83% (40/48) |
| 781 | Zm/GRMZM2G084799_T01 | 61% (105/172) | 67-114 | RGNISKEEEDIIIKL HATLGNRWSLIASHL PGRTDNEIKNYWNSH LSR | 831 | 83% (40/48) |
| 739 | At/AT3G62610.1 | 55% (106/190) | 67-114 | RGNITPEEEDVIVKL HSTLGTRWSTIASNL PGRTDNEIKNYWNSH LSR | 789 | 81% (39/48) |
| 741 | Gm/Glyma02g01740.1 | 57% (125/219) | 67-114 | RGNISAEEENTIVKL HASFGNRWSLIANHL PGRTDNEIKNYWNSH LSR | 791 | 81% (39/48) |
| 743 | Gm/Glyma03g37640.1 | 43% (143/332) | 67-114 | RGNISFLEESIILKL HASFGNRWSLIASHL PGRTDNEIKNYWNSH LSR | 793 | 81% (39/48) |
| 767 | Os/LOC_Os01g19970.1 | 52% (124/237) | 67-114 | RGNISPQEEDIILNL HATLGNRWSLIAGHL PGRTDNEIKNYWNSH LSR | 817 | 81% (39/48) |
| 769 | Zm/GRMZM2G051256_T01 | 78% (94/119) | 67-114 | RGNISEEEEDMIIKL HATLGNRWSLIAGHL PGRTDNEIKNYWNSH LSR | 819 | 81% (39/48) |
| 771 | Zm/GRMZM2G051528_T01 | 79% (94/118) | 67-114 | RGNITEEEEDVIVKL HATLGNRWSLIAGHL PGRTDNEIKNHWNSH LRR | 821 | 81% (39/48) |
| 777 | Zm/GRMZM2G022686_T01 | 61% (106/173) | 67-114 | RGNISKEEEDVIIKL HATLGNRWSLIASHL PGRTDNEIKNYWNSH LSR | 827 | 81% (39/48) |

TABLE 10-continued

MYB111 Glade sequences and conserved second SANT
domains of MYB111 and closely related sequences

| Col. 1 SEQ ID NO: | Col. 2 Species/ Identifier | Col. 3 Percent identity of polypeptide in Col. 1 to MYB111 | Col. 4 SANT domain 2 in amino acid coordinates | Col. 5 Conserved SANT domain 2 | Col. 6 SEQ ID NO: of SANT domain 2 | Col. 7 Percent identity of second SANT domain in Col. 5 to SANT domain 2 of MYB111 |
|---|---|---|---|---|---|---|
| 783 | Si/Si039538m | 81% (97/119) | 67-114 | RGNISKEEEDVIIKL HATLGNRWSLIASHL PGRTDNEIKNYWNSH LSR | 833 | 81% (39/48) |
| 757 | Sl/Solyc12g 049350.1.1 | 76% (94/123) | 67-114 | RGNITSEEEAIIIKL RATLGNRWSLIAEYL PHRTDNEIKNYWNSR LCR | 807 | 77% (37/48) |
| 745 | Gm/Glyma19g 40250.1 | 81% (97/119) | 67-114 | RGNFSVEEESTILKL HASFGSSWSLIASHL PGRTDNEIKNYWNSH LSR | 795 | 72% (35/48) |
| 775 | Os/LOC_Os03g 19120.1 | 64% (94/146) | 67-141 | RGNISNQEEDVIIKL HATLGNRKSYVVKRM DYVCLGARDYCFQQN THVRWSLIASHLPGR TDNEIKNYWNSHLSR | 825 | 52% (39/75) |

Species abbreviations for Tables 9 and 10:
At—Arabidopsis thaliana;
Gm—Glycine max;
Os—Oryza sativa;
Pt—Populus trichocarpa;
Si—Setaria italica;
Sl—Solanum lycopersicum;
Zm—Zea mays Sequences that are functionally-related and/or closely-related to the polypeptides in Tables 9 and 10 may be created artificially, semi-synthetically, or may occur naturally by having descended from the same ancestral sequence as the disclosed MYB111-related sequences, where the polypeptides have the function of conferring increased photosynthetic resource use efficiency to plants.

Figure 16A:
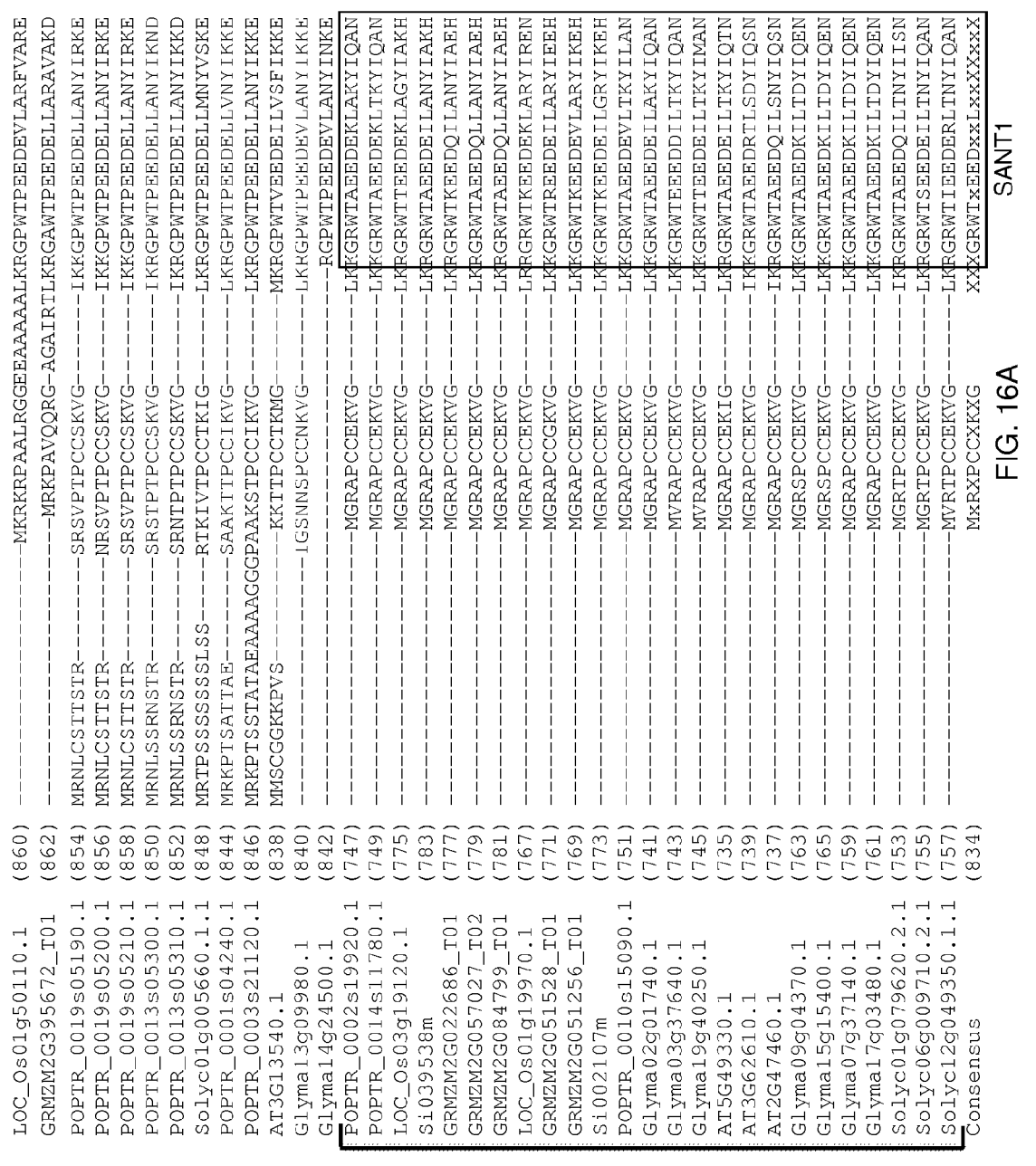
Figure 16B:
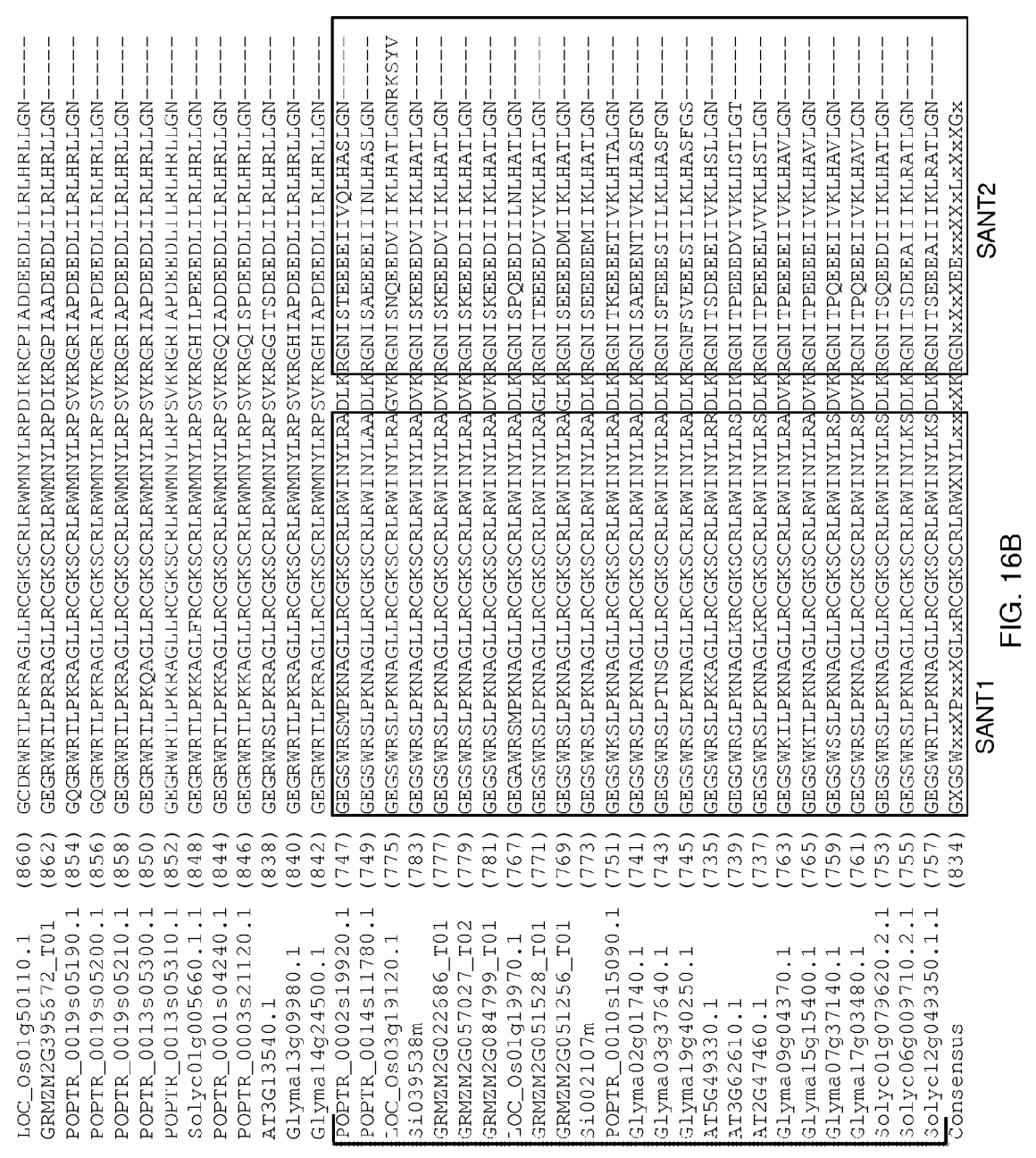
Figure 16D:
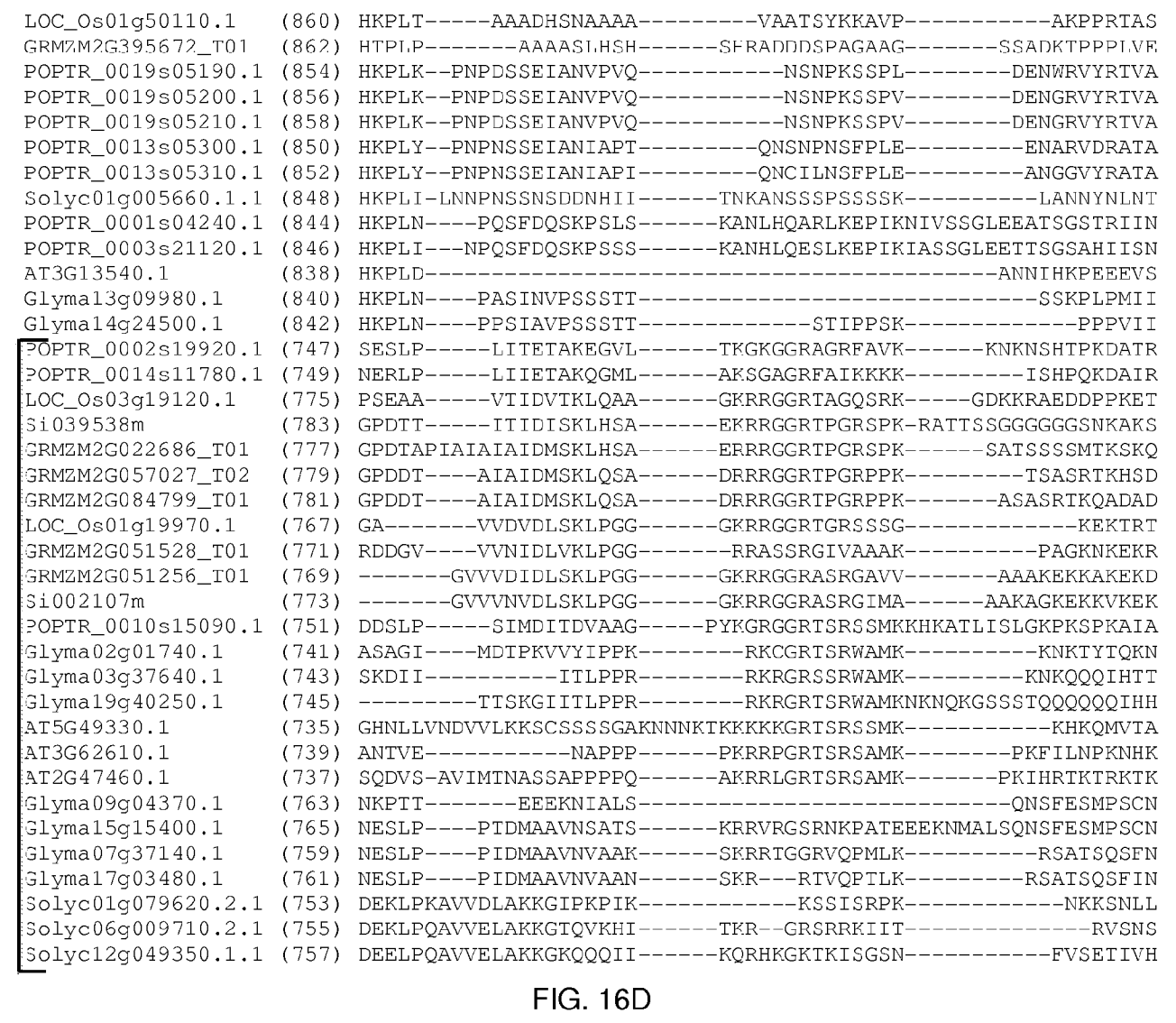
Figure 16E:
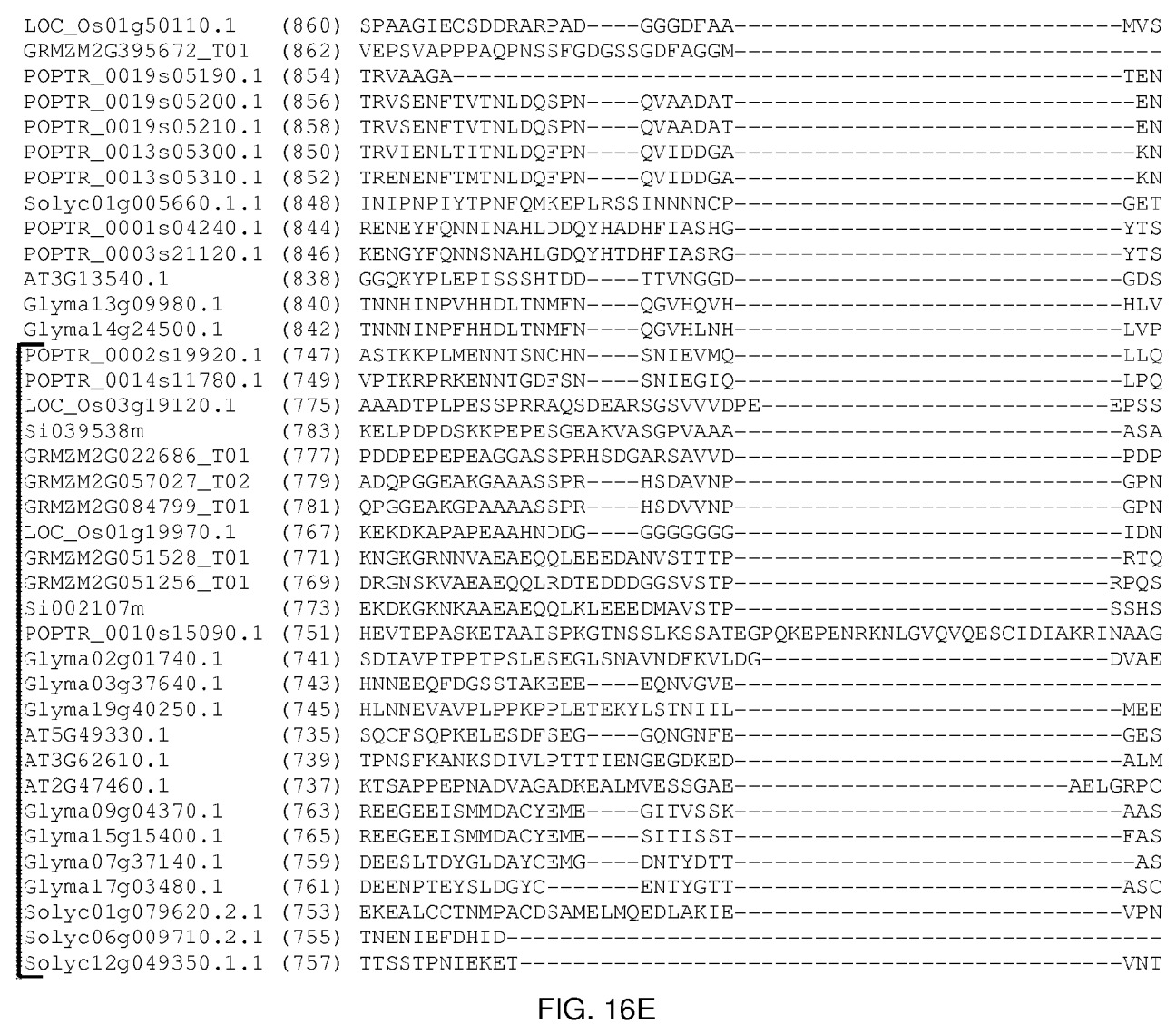
Figure 16G:
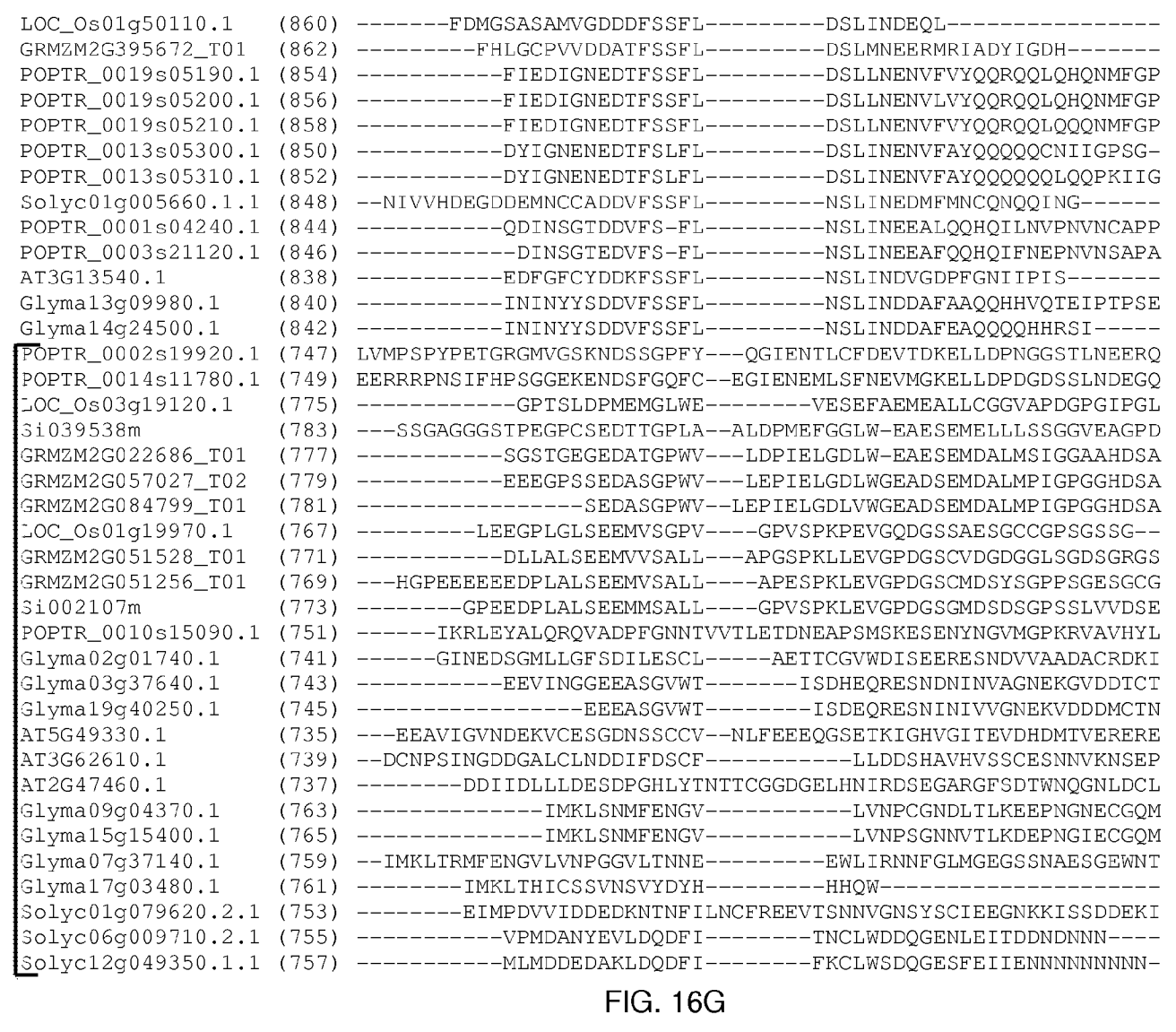

As shown in FIG. 16A-16C, these "functionally-related and/or closely-related" MYB111 clade polypeptides generally contain a consensus sequence of the MYB111 clade, SEQ ID NO: 834:

MxRX$^1$PCCX$^2$KX$^3$GX$^3$X$^4$X$^4$GRWTxEEDxxLxxX$^5$X$^3$xxX$^6$GX$^7$GSWxx

X$^3$PxxX$^1$GLxRCGKSCRLRWX$^3$NYLxxxX$^3$KRGNxX$^1$xX$^8$EExxX$^3$X$^3$ xLxX$^1$xX$^9$GXXXXXXXXXXXXXXXXXXXXXXXXXxWSxIAxxX$^3$ xxRTDNEX$^3$KNxWNX$^1$xLxX$^4$X$^{10}$.*

As shown in FIG. 16A-16B, these "functionally-related and/or closely-related" MYB111 clade polypeptides also generally contain a consensus first SANT domain sequence SEQ ID NO: 835 which is found within the MYB111 clade consensus sequence:

X$^4$GRWTxEEDxxLxxX$^5$X$^3$xxX$^6$GX$^7$GSWxxX$^3$PxxX$^1$GLxRCGKSC

RLRWX$^3$NYL.*

As shown in FIG. 16B-16C, the instant "functionally-related and/or closely-related" MYB111 clade polypeptides also generally contain a consensus second SANT domain sequence, SEQ ID NO: 836 which is also found within the MYB111 clade consensus sequence:

RGNxX$^1$xX$^8$EExxX$^3$X$^3$xLxX$^1$xX$^9$GXXXXXXXXXXXXXXXXXXXX

XXXXXXxWSxIAxxX$^3$xxRTDNEX$^3$KNxWNX$^1$xLxX$^4$.*

*In the above consensus sequences of SEQ ID NO: 834, 835, or 836, x represents any amino acid; X$^1$ is S, A, or T; X$^2$ is E or G; X$^3$ is I, V, L, or M; X$^4$ is K or R; X$^5$ is Y or F; X$^6$ is N or H; X$^7$ is E or Q; X$^8$ is E, D, or Q; X$^9$ is L or F; and X$^{10}$ is R, K, or Q. Alternative consensus sequences comprising the above with conservative substitutions found in Table 1 and Tables 9 and 10 are also envisaged and may be expected to provide equivalent function(s) in MYB-(R1) R2R3 regulatory proteins.

The presence of one or more of these consensus sequences and/or these amino acid residues is correlated with conferring of improved or increased photosynthetic resource use efficiency to a plant when the expression level of the polypeptide is altered in a plant by being reduced, knocked-out, or overexpressed. A MYB111 clade polypeptide sequence that is "functionally-related and/or closely-related" to the listed full length protein sequences or domains provided in Tables 9 or 10 may also have at least 42%, 43%, 52%, 55%, 56%, 57%, 58%, 61%, 64%, 73%, 75%, 76%, 78%, 79%, 80%, 81%, 82%, 83%, or about 100% amino acid identity to SEQ ID NO: 735, and/or at least 81%, 83%, 85%, 87%, 89%, 91%, or about 100% amino acid identity to the first SANT domain of SEQ ID NO: 735, and/or at least 52%, 72%, 77%, 81%, 83%, 85%, 87%, or about 100% amino acid identity to the second SANT domain of SEQ ID NO: 735 in its amino acid sequence to the entire length of a listed sequence or to a listed first SANT domains, or to a listed second SANT domains, or to the amino acid sequence of SEQ ID NO: 735, 737, 739, 741, 743, 745, 747, 749, 751, 753, 755, 757, 759, 761, 763, 765, 767, 769, 771, 773, 775, 777, 779, 781, or 783, or 784-833. The presence of the disclosed conserved first SANT domains and/or second SANT domains in the polypeptide sequence (for example, SEQ ID NO: 784-833), is correlated with the conferring of improved or increased photosynthetic resource use efficiency to a plant when the expression level of the polypeptide is altered in a plant by being reduced, knocked-out, or overexpressed. All of the sequences that adhere to these functional and sequential relationships are herein referred to as "MYB111 clade polypeptides" or "MYB111 clade polypeptides", or which fall within the "MYB111 clade" or "G1640 clade" exemplified in the phylogenetic tree in FIG. 15 as those polypeptides bounded by LOC_Os01g19970.1 and Glyma15g15400.1 (indicated by the box around these sequences).

TABLE 11

Conserved BTB domains of AtNPR3 and closely related sequences

| Col. 1 SEQ ID NO: | Col. 2 Species/ Identifier | Col. 3 Percent identity of polypeptide in Col. 1 to AtNPR3 | Col. 4 BTB domains in amino acid coordinates | Col. 5 Conserved BTB domains | Col. 6 SEQ ID NO: of BTB domains | Col. 7 Percent identity of the BTB domains in Col. 5 to the BTB domain of AtNPR3 |
|---|---|---|---|---|---|---|
| 864 | At/AtNPR3 or AT5G45110.1 | 100% (586/586) | 61-185 | DAEIIVDGVPVGVHRCI LAARSKFFQDLFKKEKK ISKTEKPKYQLREMLPY GAVAHEAFLYFLSYIYT GRLKPFPLEVSTCVDPV CSHDCCRPAIDFVVQLM YASSVLQVPELVSSFQR RLCNFV | 923 | 100% (143/143) |
| 920 | Pt/POPTR_ 0012s11900.1 | 61% (334/543) | 65-190 | DADIVVEGIAVGVHRCI LASRSKFFHELFRREKG SLEKDGKPKYCMSELLP YGNVGYEAFLIFLSYLY TGKLKPSPMEVSTCVDN VCAHDSCRPAITFAVEL TYASSIFQVPELVSLFQ RRLLNFV | 949 | 69% (87/126) |
| 908 | Pt/POPTR_ 0015s15800.1 | 62% (350/564) | 65-190 | DADIVVEGTAIGVHRCI LGARSKFFHELFRREKG SSEKEGKPKYCMSDLLP CGKVGYEAFLIFLSYLY TGKLKPSPMEVSTCVDN VCAHDACRPAINFAVEL MYASSIFQVPELVSLFQ RRLQNFV | 945 | 68% (86/126) |
| 918 | Gm/Glyma09g 02430.1 | 63% (333/527) | 65-190 | DADLVVEGIPVSVHRCI LASRSKFFHELFKREKG SSEKEGKLKYNMNDLLP YGKVGYEAFLIFLGYVY TGKLKPSPMEVSTCVDN VCAHDACRPAINFAVEL MYASSIFQIPELVSLFQ RRLLNFI | 948 | 66% (84/126) |
| 922 | Gm/Glyma15g 13320.1 | 62% (328/527) | 65-190 | DADIVVEGISVSVHRCI LASRSKFFHELFKREKG SSEKEGKLKYNMSDLLP YGKVGYEAFLIFLGYVY TGKLKPSPMEVSTCVDS VCAHDACRPAINFAVEL MYASYIFQIPEFVSLFQ RRLLNFI | 950 | 65% (82/126) |
| 916 | Eg/Eucgr. E01922.1 | 59% (314/526) | 65-190 | DADIVVENISVGVHRCI LAARSDFFNNLFKREKG SSEKEGKPKYNMDDLLP YGKVGYEAFLIFLSYAY | 947 | 65% (82/126) |

TABLE 11-continued

Conserved BTB domains of AtNPR3 and closely related sequences

| Col. 1 SEQ ID NO: | Col. 2 Species/ Identifier | Col. 3 Percent identity of polypeptide in Col. 1 to AtNPR3 | Col. 4 BTB domains in amino acid coordinates | Col. 5 Conserved BTB domains | Col. 6 SEQ ID NO: of BTB domains | Col. 7 Percent identity of the BTB domains in Col. 5 to the BTB domain of AtNPR3 |
|---|---|---|---|---|---|---|
| | | | | TGKLKRSPLEVSTCVDD MCSHDACSPAINFAVEL MYASYIFQIRELVSLLQ RHLVNFV | | |
| 910 | Sl/Solyc02g 069310.2.1 | 58% (307/525) | 67-192 | DAEIVVEGVSLGVHRCI LAARSSFFRDLFRKRNG NCGKEGKPSYSMIDILP CGKVGYEAFLTFLSYLY SGKLKHFPPEASTCVNS LCSHDSCRPAINFHVEL MYASFVFQVPELVSLFL RHLFSFV | 946 | 63% (80/126) |
| 904 | Pt/POPTR_ 0002s05740.1 | 57% (227/397) | 65-190 | DAEIFVEGTPVGVHRCV LAARSQFFHELFKKGNN NSTNGDKPRYLMSDLVP YGGVGYEAFHVLHYLY TGKLKPSPPEVSRCVDD ACAHDVCRPAINYVVEL MCASATFQMKELVLLFQ RRLLNFI | 943 | 60% (76/126) |
| 894 | Gm/Glyma02g 45260.1 | 55% (294/527) | 64-189 | DAEILVEDIPVGIHRCI LASRSLFFHELFKKGTD GSGKEGKPRYLMSDLVP YGTVGYEAFQVFLYYLY TGRLKASPTEVTTCVDE TCTHDACRPAINYALEL MYASATFQMKELVLLFQ RHLLNFV | 938 | 58% (74/126) |
| 898 | Gm/Glyma02g 45260.2 | 55% (256/465) | 64-189 | DAEILVEDIPVGIHRCI LASRSLFFHELFKKGTD GSGKEGKPRYLMSDLVP YGTVGYEAFQVFLYYLY TGRLKASPTEVTTCVDE TCTHDACRPAINYALEL MYASATFQMKELVLLFQ RHLLNFV | 940 | 58% (74/126) |
| 906 | Pt/POPTR_ 0005s22770.1 | 53% (283/526) | 65-190 | DAEIVVEGIPVGVHRCI LAARSQFFHELFKKVDS NSTSGDKPRYLMSDLMP YGGVGYEAFNVLHYLY TGKHKSSPPEVSQCVYD ACAHDACRPAINYAVEL MYASATFQMKELVLLFQ RRLLSFI | 944 | 57% (72/126) |
| 896 | Gm/Glyma14g 03510.1 | 55% (293/529) | 64-189 | DAEILIEDIPVGIHRCI LASRSPFFHELFKKGTD GSGKEGKPRYLMSDLMP YGTVGYQAFQVFLYYLY TGRLKASPTEETTCVDE TCIHVACRPAINHALEL MYASATFQMKELVLLFQ RHLLNFV | 939 | 55% (70/126) |
| 892 | Cc/clementine 0.9_005587m | 53% (285/531) | 67-195 | DAEIVVEGKSVALHRCI LSARSQFFHELFKKGNN NDGSAVSEGKPKYLMTE LVPYGKVGYEALNVILY YFYTGKLKPSPSEVSTC VDDACAHDACPPAINYA IELMYASAAFQMKELVL LFQRRLLNFV | 937 | 55% (72/129) |

TABLE 11-continued

Conserved BTB domains of AtNPR3 and closely related sequences

| Col. 1 SEQ ID NO: | Col. 2 Species/ Identifier | Col. 3 Percent identity of polypeptide in Col. 1 to AtNPR3 | Col. 4 BTB domains in amino acid coordinates | Col. 5 Conserved BTB domains | Col. 6 SEQ ID NO: of BTB domains | Col. 7 Percent identity of the BTB domains in Col. 5 to the BTB domain of AtNPR3 |
|---|---|---|---|---|---|---|
| 872 | Sl/Solyc07g044980.2.1 | 51% (278/541) | 51-176 | DAEIVVEGINVGVNRCILAARSQFFHEKFKENE NSLKNEKPKYLLKDLVC VSSIGYEVFMVLLNYLY TGKIKSSPSEVSSCVDN ACAHDACRPAINYAVEL MYASSTFQIKELVMFVE RYLDNFV | 927 | 53% (68/126) |
| 900 | Eg/Eucgr.A02033.1 | 48% (258/528) | 61-186 | DAVIVVEGVPVGVHRCL LAARSQFLHEFFKQGGG DNAREGKPRYPISDLVK KGHVGCEAFKYVLRYMY TGKLKLFPAEVSTCVDS SCAHDVCGPAINYAVEL MYASATFLIAELVMLVQ RRLLHFI | 941 | 53% (68/126) |
| 902 | Eg/Eucgr.A02033.2 | 51% (189/368) | 61-186 | DAVIVVEGVPVGVHRCL LAARSQFLHEFFKQGGG DNAREGKPRYPISDLVK KGHVGCEAFKYVLRYMY TGKLKLFPAEVSTCVDS SCAHDVCGPAINYAVEL MYASATFEIAELVMLVQ RRLLHFI | 942 | 53% (68/126) |
| 878 | Bd/Bradi1g12870.1 | 47% (256/538) | 57-187 | DAEVVLADGGDEATVPV HRCILAARSNFFLDHFS SLSSPAAGGGKPRLELA ELVPGGRHVGHEALVAV LGYLYTGRLKPPPQEAA ICVDDRCRHQACRPAID EVVESTYAASGFQISEL VSLFQRRLSDFV | 930 | 52% (69/131) |
| 882 | Si/Si034834m | 47% (256/538) | 56-186 | DAEVALAAGKGGAAVGV HRCILAARSALFRDHFA SLPPPAAVGEKPRLELA DLVPGGRHIGQDALVPV LGYLYTGRLKSAPQDAT VCMDDACGHGACRPAID FVVESMYAASGFQISEL VSLFQRRLSDFV | 932 | 49% (65/131) |
| 890 | Cc/clementine0.9_005201m | 46% (246/525) | 92-217 | DAEIVVEGKSVAVNRSI LSERSQFFRRLFNLRND GSVSEGKPKYLLTDLVP HGKVGYEAFNDTLHYIY TGKTKAPPPEVSTCVDD ACVHVSCPPTINYVIEL MYASAALQMKKLVIRLE LWLLNLV | 936 | 50% (63/126) |
| 888 | Zm/GRMZM2G115162_T01 | 47% (256/541) | 45-175 | DAEIALAAARGGGAVGV HRCILAARSAFFLDHLA SLPAPAAAGERPRLELA DLVPGGRHIGRDALVPV LGYLYTGRLKPPAQDAT VCMDDACGHGTCRPAID FVVESMYAASGFQISEL ASLFQRRLSDFV | 935 | 48% (64/131) |
| 880 | Os/LOC_Os03g46440.3 | 48% (263/545) | 51-187 | DAEIVLASGGGDPGGGA VVGVHRCILAARSRFFY DHFSSAPAPAPATAGDK | 931 | 48% (67/137) |

TABLE 11-continued

Conserved BTB domains of AtNPR3 and closely related sequences

| Col. 1 SEQ ID NO: | Col. 2 Species/ Identifier | Col. 3 Percent identity of polypeptide in Col. 1 to AtNPR3 | Col. 4 BTB domains in amino acid coordinates | Col. 5 Conserved BTB domains | Col. 6 SEQ ID NO: of BTB domains | Col. 7 Percent identity of the BTB domains in Col. 5 to the BTB domain of AtNPR3 |
|---|---|---|---|---|---|---|
| | | | | PQLDLDGLVPGGRHIGR DALVAVLSYLYTGRLRS APPEAAACLDDGCSHDA CRPAIDFVVESTYAASG FQISELVSLFQRRLSDF V | | |
| 884 | Os/LOC_Os03g 46440.1 | 48% (263/545) | 51-187 | DAEIVLASGGGDPGGGA VVGVHRCILAARSRFFY DHFSSAPAPAPATAGDK PQLDLDGLVPGGRHIGR DALVAVLSYLYTGRLRS APPEAAACLDDGCSHDA CRPAIDFVVESTYAASG FQISELVSLFQRRLSDF V | 933 | 48% (67/137) |
| 886 | Os/LOC_Os03g 46440.2 | 48% (263/545) | 51-187 | DAEIVLASGGGDPGGGA VVGVHRCILAARSRFFY DHFSSAPAPAPATAGDK PQLDLDGLVPGGRHIGR DALVAVLSYLYTGRLRS APPEAAACLDDGCSHDA CRPAIDFVVESTYAASG FQISELVSLFQRRLSDF V | 934 | 48% (67/137) |
| 874 | Bd/Bradi2g 51030.1 | 52% (289/547) | 81-225 | DADVDMADGGPLVPVHR CILAARSPFFHEFFAAR GRGNSGDGPPSASAAGV GGGGEGTGRPRYKMEEL VPGGRVGREAFLGFMRY LYTGKLRPAPPDVVSCV DPVCPHDSCPPAIRFAV ELMYAASTFNIPELISL FQRRLLNFV | 928 | 48% (70/145) |
| 868 | Si/Si000647m | 52% (298/573) | 82-225 | DADIEVPDGGPPVPVHR CILAVRSPFFYDIFAAR GRGGAARGDAAAGARGA GEGAASGRPRYKMEELV PGGRVGREAFQAFLGYL YTGKLRPAPLDVVSCAD PVCPHDSCPPAIRFAVE LMYAAWTFKIPELISLF QRRLLNFV | 925 | 46% (67/143) |
| 870 | Si/Si000671m | 52% (298/563) | 82-225 | DADIEVPDGGPPVPVHR CILAVRSPFFYDIFAAR GRGGAARGDAAAGARGA GEGAASGRPRYKMEELV PGGRVGREAFQAFLGYL YTGKLRPAPLDVVSCAD PVCPHDSCPPAIRFAVE LMYAAWTFKIPELISLF QRRLLNFV | 926 | 46% (67/143) |
| 866 | Zm/GRMZM2 G076450_T01 | 53% (291/545) | 82-225 | DADVDVPDGGPPVPIHR CILAARSDFFYDLFAAR GRAGAARGDAAAGAGVA AEGAASGRPRYKMEDLV PAGRVGREAFQAFLGYL YTGKLRPAPVDVVSCAD PVCHHDSCPPAIRSAVE LMYAACTFKIPELTSLF QRRLLNFV | 924 | 44% (64/143) |

TABLE 11-continued

Conserved BTB domains of AtNPR3 and closely related sequences

| Col. 1 SEQ ID NO: | Col. 2 Species/ Identifier | Col. 3 Percent identity of polypeptide in Col. 1 to AtNPR3 | Col. 4 BTB domains in amino acid coordinates | Col. 5 Conserved BTB domains | Col. 6 SEQ ID NO: of BTB domains | Col. 7 Percent identity of the BTB domains in Col. 5 to the BTB domain of AtNPR3 |
|---|---|---|---|---|---|---|
| 876 | Os/LOC_Os01g 56200.1 | 51% (287/558) | 98-241 | DADVDVADGGPPVPVHR CILAARSTFFYNLFAAR GRGGDGAAGGGGGGGG GGERTGGRPRYKMEELV PGGRVGRDAFLSLLGYL YTGKLRPAPDDVVSCAD PMCPHDSCPPAIRFNVE QMYAAWAFKITELISLF QRRLLNFV | 929 | 43% (62/143) |

TABLE 12

Conserved ANK repeats of AtNPR3 and closely related sequences

| Col. 1 SEQ ID NO: | Col. 2 Species/ Identifier | Col. 3 Percent identity of Polypeptide in Col. 1 to AtNPR3 | Col. 4 ANK repeats in amino acid coordinates | Col. 5 Conserved ANK repeats | Col. 6 SEQ ID NO: of ANK repeats | Col. 7 Percent identity of the ANK repeats in Col. 5 to the ANK repeats of AtNPR3 |
|---|---|---|---|---|---|---|
| 864 | At/AtNPR3 or AT5G45110.1 | 100% (586/586) | 266-355 | ILKALDSDDVELVKLL LTESDITLDQANGLHY SVVYSDPKVVAEILAL DMGDVNYRNSRGYTVL HFAAMRREPSIIISLI DKGANASEFT | 951 | 100% (90/90) |
| 910 | Sl/Solyc02g 069310.2.1 | 58% (307/525) | 273-362 | IYKALDSDDVELVKLL LNESDISLDGAYALHY AVAYCDPKVVAEVLGL GVANVNLRNARGYTVL HIAAMRKEPSIIVSLL TKGAHASEIT | 974 | 73% (66/90) |
| 912 | Gm/Glyma15g 13320.2 | 60% (233/382) | 90-179 | IHKALDSDDVELVKLL LNESDITLDEANALHY AAAYCDPKVVSEVLGL GLANVNLRNSRGYTVL HIAAMRKEPSIIVSLL TKGACASDLT | 975 | 73% (66/90) |
| 918 | Gm/Glyma09g 02430.1 | 63% (333/527) | 272-361 | IHKALDSDDVELVKLL LNESDITLDEANALHY AAAYCDPKVVSEVLGL GLANVNLRNSRGYTVL HIAAMRKEPSIIVSLL TKGACASDLT | 978 | 73% (66/90) |
| 922 | Gm/Glyma15g 13320.1 | 62% (328/527) | 272-361 | IHKALDSDDVELVKLL LNESDITLDEANALHY AAAYCDPKVVSEVLGL GLANVNLRNSRGYTVL HIAAMRKEPSIIVSLL TKGACASDLT | 980 | 73% (66/90) |
| 914 | Vv/GSVIVT01 026274001 | 60% (241/398) | 106-195 | ILKALDSDDVELVKLL LSESGITLDEAYALHY AAAYCDPKVVSEVLSL GLADVNRHNPRGYTVL | 976 | 72% (65/90) |

TABLE 12-continued

Conserved ANK repeats of AtNPR3 and closely related sequences

| Col. 1 SEQ ID NO: | Col. 2 Species/ Identifier | Col. 3 Percent identity of Polypeptide in Col. 1 to AtNPR3 | Col. 4 ANK repeats in amino acid coordinates | Col. 5 Conserved ANK repeats | Col. 6 SEQ ID NO: of ANK repeats | Col. 7 Percent identity of the ANK repeats in Col. 5 to the ANK repeats of AtNPR3 |
|---|---|---|---|---|---|---|
| | | | | HVAAMRKEPSIIVSLL TKGAHASERT | | |
| 908 | Pt/POPTR_ 0015s15800.1 | 62% (350/564) | 272-361 | IHMALDSDDVELVKLL LTESDITLDDANALHY AASYCDLKVVSEVLSL GLADVNLRNSRGYTVL HIAAMRKEPSVIVSML AKGASALDLT | 973 | 71% (62/87) |
| 920 | Pt/POPTR_ 0012s11900.1 | 61% (334/543) | 272-361 | IHMALDSDDVELVKLL LTESDISLDDANALHY CASYCDLKVMSEVLSL GLANVNLRNSRGYTVL HIAAMRKEPSVIVSLL AKGASALDLT | 979 | 68% (60/87) |
| 866 | Zm/GRMZM2 G076450_T01 | 53% (291/545) | 306-395 | IHRALDSDDVELVKLL LNESDITLDDANALHY AASYCDPKVVSELLDL AMANLNLKNSRGYTAL HLAAMRREPAIIMCLL NKGANVSQLT | 952 | 68% (62/90) |
| 904 | Pt/POPTR_ 0002s05740.1 | 57% (227/397) | 272-361 | IHKALDSDDVELVELL LSESNLTLDDAYALHY AVAYCDPKIVKEVLSL GSADLNLRNSRGYSVL HVAARRKEPSIIMALL TRGASASETT | 971 | 67% (59/88) |
| 906 | Pt/POPTR_ 0005s22770.1 | 53% (283/526) | 272-361 | IHKALESDDVELVQLL LSESNFTLDDAYALHY AVSYCDPKVVKEVLAL GLADLNLRNSRGYTVL HVAARRKESSILVALL AKGARASEIT | 972 | 66% (60/90) |
| 916 | Eg/Eucgr. E01922.1 | 59% (314/526) | 272-361 | IHKALDSDDIELVTLL LSESNINLDEAYGLHY AAAYCDPKVVSELLGL GLANVNLRNPRGYTVL HVAAMRKETKIIVSLL SKGACASELT | 977 | 66% (60/90) |
| 868 | Si/Si000647m | 52% (298/573) | 306-395 | IHRALDSDDVELVKLL LNESEITLDDANALHY AASYCDSKVVSELLEL GLANLNLKNSRGYTAL HLAAMRREPAIIMCLL NKGATVSQLT | 953 | 64% (58/90) |
| 870 | Si/Si000671m | 52% (298/563) | 306-395 | IHRALDSDDVELVKLL LNESEITLDDANALHY AASYCDSKVVSELLEL GLANLNLKNSRGYTAL HLAAMRREPAIIMCLL NKGATVSQLT | 954 | 64% (58/90) |
| 874 | Bd/Bradi2g 51030.1 | 52% (289/547) | 306-395 | IHRALDSDDVELVKLL LNESEITLDDANALHY AAAYCDSKVVSELLDL GLANLNLKNNRGYTAL HLAAMRREPTIIMCLL NKGAVASQLT | 956 | 64% (58/90) |

TABLE 12-continued

Conserved ANK repeats of AtNPR3 and closely related sequences

| Col. 1 SEQ ID NO: | Col. 2 Species/ Identifier | Col. 3 Percent identity of Polypeptide in Col. 1 to AtNPR3 | Col. 4 ANK repeats in amino acid coordinates | Col. 5 Conserved ANK repeats | Col. 6 SEQ ID NO: of ANK repeats | Col. 7 Percent identity of the ANK repeats in Col. 5 to the ANK repeats of AtNPR3 |
|---|---|---|---|---|---|---|
| 876 | Os/LOC_Os01g 56200.1 | 51% (287/558) | 322-411 | IHRALDSDDVELVKLL LNESEITLDDANALHY AAAYCDSKVVSELLDL RLANLNLKNSRGYTAL HLAAMRREPAIIMCLL NKGAAVSQLT | 957 | 64% (58/90) |
| 894 | Gm/Glyma02g 45260.1 | 55% (294/527) | 271-360 | IHKALDSDDVELLKLL LNESSVTLDDAHALHY ACAYSDSKVIQEVLSL GMADILRRNSRGYTVL HVAARRKDPSILVALL NKGACASDTT | 966 | 63% (57/90) |
| 896 | Gm/Glyma14g 03510.1 | 55% (293/529) | 271-360 | IHKALDSDDVELLKLL LNESSVTLDDAYALHY ACAYSDSKVIQEVLSL GMADILRRNSRGYTVL HVAARRKDPSILVALL NKGARASDTT | 967 | 63% (57/90) |
| 898 | Gm/Glyma02g 45260.2 | 55% (256/465) | 271-360 | IHKALDSDDVELLKLL LNESSVTLDDAHALHY ACAYSDSKVIQEVLSL GMADILRRNSRGYTVL HVAARRKDPSILVALL NKGACASDTT | 968 | 63% (57/90) |
| 888 | Zm/GRMZM2 G115162_T01 | 47% (256/541) | 252-341 | ILKALDSDDVDLVGLL LKESTVTLDDAFAIHY AAAYCEPKVFAELLKL DSANVNLKNSGGYTPL HIACMRREPDIILSLV ERGACVLERT | 963 | 61% (55/90) |
| 878 | Bd/Bradi1g 12870.1 | 47% (256/538) | 268-357 | IHKALDSDDVALVGML LKESAITLDDAHAIHY AAAYCEPKVLAGMLNL DSANVNLKNDSGYTPL HIACMRREPDIIVSLI EKGASVLERT | 958 | 60% (54/90) |
| 880 | Os/LOC_Os03g 46440.3 | 48% (263/545) | 265-354 | IHKALDSDDVDLVGML LKESPVTLDDAFAIHY AAAYCEPKVLAELLKL ESANVNLKNSSGYTPL HMACMRREPDIIVSLI EKGASVLERT | 959 | 60% (54/90) |
| 884 | Os/LOC_Os03g 46440.1 | 48% (263/545) | 265-354 | IHKALDSDDVDLVGML LKESPVTLDDAFAIHY AAAYCEPKVLAELLKL ESANVNLKNSSGYTPL HMACMRREPDIIVSLI EKGASVLERT | 961 | 60% (54/90) |
| 886 | Os/LOC_Os03g 46440.2 | 48% (263/545) | 265-354 | IHKALDSDDVDLVGML LKESPVTLDDAFAIHY AAAYCEPKVLAELLKL ESANVNLKNSSGYTPL HMACMRREPDIIVSLI EKGASVLERT | 962 | 60% (54/90) |
| 882 | Si/Si034834m | 47% (256/538) | 267-356 | ILKALDSDDVDLVGLL LKESAVTLDDAFAVHY AAAYCEPKVFAELLKL | 960 | 58% (53/90) |

TABLE 12-continued

Conserved ANK repeats of AtNPR3 and closely related sequences

| Col. 1 SEQ ID NO: | Col. 2 Species/ Identifier | Col. 3 Percent identity of Polypeptide in Col. 1 to AtNPR3 | Col. 4 ANK repeats in amino acid coordinates | Col. 5 Conserved ANK repeats | Col. 6 SEQ ID NO: of ANK repeats | Col. 7 Percent identity of the ANK repeats in Col. 5 to the ANK repeats of AtNPR3 |
|---|---|---|---|---|---|---|
| | | | | NSANVNLKNNSGYTPL HIACMRREPDIILSLV ERGASVMERT | | |
| 872 | Sl/Solyc07g 044980.2.1 | 51% (278/541) | 256-346 | ILKALESDDIELLTLL LEESNVTLNDACALHY AAAYCNSKVVNEVLEL GLGADVNLQNSRGYNV LHVAARRKEPSIIMGL LAKGASVLDTT | 955 | 58% (53/91) |
| 892 | Cc/clementine 0.9_005587m | 53% (285/531) | 277-366 | IHKALDSDDVELLKLL LDESNVTLDDAYALHY AAAYCNPKVFKEVLNM GLADLNLKNARGHTVL HVAARRKEPAVLVTLL SKGACASETT | 965 | 57% (52/90) |
| 900 | Eg/Eucgr. A02033.1 | 48% (258/528) | 268-357 | IHKALDNDDVELVRRL LNESVVTLDDAYALHY ATAYCHPKIFKEVLGL GLADLNLKDSRGYTVL HVAARRKAPSILLPLL YKGACAMEST | 969 | 56% (51/90) |
| 902 | Eg/Eucgr. A02033.2 | 51% (189/368) | 268-357 | IHKALDNDDVELVRRL LNESVVTLDDAYALHY ATAYCHPKIFKEVLGL GLADLNLKDSRGYTVL HVAARRKAPSILLPLL YKGACAMEST | 970 | 56% (51/90) |
| 890 | Cc/clementine 0.9_005201m | 46% (246/525) | 299-388 | IHKALDSDDVELLKLL LDVSNVTLDDAYALHY AAAYCSPKVFKEVLNM DLACLNLKDARGRTVL HVAARRNEPEVMVTLL SKGACASETT | 964 | 55% (50/90) |

Species abbreviations for Tables 11 and 12:
At—Arabidopsis thaliana;
Bd—Brachypodium distachyon;
Cc—Citrus clementina;
Eg—Eucalyptus grandis;
Gm—Glycine max;
Os—Oryza sativa;
Pt—Populus trichocarpa;
Si—Setaria italica;
Sl—Solanum lycopersicum;
Vv—Vitis vinifera;
Zm—Zea mays Sequences that are functionally-related and/or closely-related to the polypeptides in Tables 11 and 12 may be created artificially, semi-synthetically, or may occur naturally by having descended from the same ancestral sequence as the disclosed AtNPR3-related sequences, where the polypeptides have the function of conferring increased photosynthetic resource use efficiency to plants.

As shown in FIGS. 18B-18C, these "functionally-related and/or closely-related" AtNPR3 clade polypeptides generally contain a consensus sequence within the BTB domain of the AtNPR3 clade:

(SEQ ID NO: 981)
$DAxX^2xX^2xX^1X^1X^1X^1X^1X^1X^1xxxX^2xX^2X^3RX^4X^2LX^5xRSx$ $FX^6xxxX^6*$.

As shown in FIGS. 18D-18E, these "functionally-related and/or closely-related" AtNPR3 clade polypeptides generally also contain another consensus sequence within the BTB domain of the AtNPR3 clade:

(SEQ ID NO: 982)
$X^7xxxxxX^2xxX^2X^2xxX^8xX^9X^2xxX^{10}xX^6xxxxX^2xYxYX^5GX^7xX^7$ $xxxxxX^{11}xxxCxxxxCxHxxCxPX^5IxxxxX^2X^{12}xxxAX^5xxX^6x$ $X^2xxX^2xxxxxxxLxxX^6X^2*$.

As shown in FIGS. 18F-18H, these "functionally-related and/or closely-related" AtNPR3 clade polypeptides also generally contain a consensus ANK domain sequence:

(SEQ ID NO: 983)
$IxxALX^{11}xDDX^2xLX^2xxLLxxSxxxLX^{13}xAxxX^2HYxxxYX^4$ $xxKX^2xxxX^2LxX^2xxX^{14}xxX^2xxX^{15}X^{13}xxGxxxLHxAxxRx$ $xxxxX^2X^2X^2xX^2X^2xX^7GAxxxX^{16}*$.

There is also a small motif that is present in AtNPR3 clade member proteins between the BTB and DUF3420 domains, and is identifiable in FIG. 18E as SEQ ID NO: 984:

$X^5xxX^{11}X^{13}X^2X^2PX^2X^2xxA.*$

There is also a small motif that is present in AtNPR3 clade member proteins at the start of the DUF3420 domain, and is identifiable in FIG. 18F:

(SEQ ID NO: 985)
$SxX^{17}xxxxxX^2X^{11}X^{15}X^{18}X^2.*$

And, there is also a small motif that is present in AtNPR3 clade member proteins within the NPR1-like_C domain, and is identifiable in FIGS. 18H-18I:

(SEQ ID NO: 986)
$KxxX^2CX^2xxLX^{12}xxX^2X^{19}xX^7.*$

*In the above consensus sequences of SEQ ID NOs: 981-986, x represents any amino acid; $X^1$ is any amino acid or absent; $X^2$ is I, V, L, or M; $X^3$ is H or N; $X^4$ is C or S; $X^5$ is S, A, or T; $X^6$ is F or L; $X^7$ is K or R; $X^8$ is G or S; $X^9$ is H or absent; $X^{10}$ is E, K or Q; $X^{11}$ is E or D; $X^{12}$ is E or Q; $X^{13}$ is D or N; $X^{14}$ is G or absent; $X^{15}$ is K, R, or Q; $X^{16}$ is E, D, or Q; $X^{17}$ is I, V, L, M, or F; $X^{18}$ is E or R; and $X^{19}$ is R, Q or absent. Alternative consensus sequences comprising the above with conservative substitutions found in Table 1 are also envisaged and may be expected to provide equivalent function(s).

The presence of one or more of these consensus sequences and/or these amino acid residues is indicative of the AtNPR3 clade polypeptides and the presence of one or more of these consensus sequences is correlated with conferring improved or increased photosynthetic resource use efficiency to a plant when the expression level of the polypeptide is altered in a plant by being reduced, knocked-out, or overexpressed. An AtNPR3 clade polypeptide sequence that is "functionally-related and/or closely-related" to the listed full length protein sequences or domains provided in Tables 11 or 12 may also have at least 46%, 47%, 48%, 51%, 52%, 53%, 55%, 57%, 58%, 59%, 61%, 62%, 63%, or about 100% amino acid identity to SEQ ID NO: 864, and/or at least 43%, 44%, 46%, 48%, 49%, 50%, 52%, 53%, 55%, 57%, 58%, 60%, 63%, 65%, 66%, 68%, 69%, or about 100% amino acid identity to the BTB domain of SEQ ID NO: 864, and/or at least 55%, 56%, 57%, 58%, 60%, 61%, 63%, 64%, 66%, 67%, 68%, 71%, 72%, 73%, or about 100% amino acid identity to the ANK domain of SEQ ID NO: 864 in its amino acid sequence to the entire length of a listed sequence or to a listed BTB domains, or to a listed ANK domains, or to the amino acid sequence of SEQ ID NOs: 864, 866, 868, 870, 872, 874, 876, 878, 880, 882, 884, 886, 888, 890, 892, 894, 896, 898, 900, 902, 904, 906, 908, 910, 912, 914, 916, 918, 920, or 922, 923-980, or 951-980. The presence of the disclosed conserved BTB domains and/or ANK domains in the polypeptide sequence (for example, SEQ ID NOs: 923-980), is correlated with the conferring of improved or increased photosynthetic resource use efficiency to a plant when the expression level of the polypeptide is altered in a plant by being reduced, knocked-out, or overexpressed. All of the sequences that adhere to these functional and sequential relationships are herein referred to as "AtNPR3 clade polypeptides" or "AtNPR3 clade polypeptides", or which fall within the "AtNPR3 clade" or "G839 clade" exemplified in the phylogenetic tree in FIG. 17 as those polypeptides bounded by GRMZM2G076450_T01 and Glyma15g13320.1 (indicated by the box around these sequences).

TABLE 13

| | | | | | | |
|---|---|---|---|---|---|---|
| | | | | Conserved bHLH-MYC_N domain ("domain 1") of AtMYC1 and closely related sequences | | |
| Col. 1 SEQ ID NO: | Col. 2 Species/ Identifier | Col. 3 Percent identity of polypeptide in Col. 1 to AtMYC1 | Col. 4 bHLH-MYC_N domain in amino acid coordinates | Col. 5 Conserved bHLH-MYC_N domain sequence | Col. 6 SEQ ID NO: of bHLH-MYC_N domain | Col. 7 Percent identity of first bHLH-MYC_N domain in Col. 5 to the bHLH-MYC_N domain of AtMYC1 |
| 1016 | At/AtMYC1 or AT4G00480.1 | 526/526 (100%) | 23-217 | LRKQLALAVRSVQWS YAIFWSSSLTQPGVL EWGEGCYNGDMKKRK KSYESHYKYGLQKSK ELRKLYLSMLEGDSG TTVSTTHDNLNDDDD NCHSTSMMLSPDDLS DEEWYYLVSMSYVFS | 1073 | 195/195 (100%) |

TABLE 13-continued

Conserved bHLH-MYC_N domain ("domain 1") of AtMYC1 and closely related sequences

| Col. 1 SEQ ID NO: | Col. 2 Species/ Identifier | Col. 3 Percent identity of polypeptide in Col. 1 to AtMYC1 | Col. 4 bHLH-MYC_N domain in amino acid coordinates | Col. 5 Conserved bHLH-MYC_N domain sequence | Col. 6 SEQ ID NO: of bHLH-MYC_N domain | Col. 7 Percent identity of first bHLH-MYC_N domain in Col. 5 to the bHLH-MYC_N domain of AtMYC1 |
|---|---|---|---|---|---|---|
| | | | | PSQCLPGRASATGET IWLCNAQYAENKLFS RSLLARSASIQTVVC FPYLGGVIELGVTEL ISEDHNLLRNIKSCL | | |
| 1018 | LOC_Os01g 39560.1 | 88/184 (47%) | 19-196 | FRKQLAAAVRSISWT YAIFWSISTTRPGVL TWNDGFYNGEIKTRK IENNLVTELTAEQLL LQRSEQLRELYNSLL SGESADQQRRRPVTA LSPEDLGNVEWYYVV CMTYAFRPGQCVPGK SFASNGCAWLCNAQS ADSKAFPRKLLAKNA SIQTIVCVPFMTGVL ELGTTDPAAVARG | 1075 | 87/184 (47%) |
| 1020 | LOC_Os04g 47040.1 | 92/201 (45%) | 19-202 | FRSLLAAAVRSISWS YAIFWSISTSCPGVL TWNDGFYNGVVKTRK ISNSADLTAGQLVVQ RSEQLRELYYSLLSG ECDHRARRPIAALSP EDLADTEWYYVVCMT YSFQPGQGLPGKSYA SNASVWLRNAQSADS KTFLRSLLAKSASIQ TIICIPFTSGVLELG TTDPVLEDPKLVNRI VAYF | 1077 | 91/194 (46%) |
| 1022 | LOC_Os04g 47080.1 | 90/201 (44%) | 12-196 | FRSQLAAAARSINWT YAIFWSISTSRPGVL TWKDGFYNGEIKTRK ITNSMNLMADELVLQ RSEQLRELYDSLLSG ECGHRARRPVAALLP EDLGDTEWYYVVCMT YAFGPRQGLPGKSFA SNEFVWLTNAQSADR KLFHRALIAKSASIK TIVCVPFIMHGVLEL GTTDPISEDPALVDR IAASF | 1079 | 90/197 (45%) |
| 1024 | GRMZM2G172 795_T01 | 158/564 (28%) | 20-180 | LRKQLAAAARSINWS YSLFWSISSTQRPRV LTWTDGFYNGEVKTR KISHSVELTADQLLM QRSEQLRELYEALQS GECDRRAARPVGSLS PEDLGDTEWYYVICM TYAFLPGQGLPGRSS ASNEHVWLCNAHLAG SKDFPRALLAKVPED PDLINRATAAF | 1081 | 71/160 (44%) |
| 1026 | GRMZM5G822 829_T01 | 67/172 (38%) | 20-179 | LEKKLSRVLTWTDGF YNGEVKTRKISNSVE LTSDHLVMQRSDQLR ELYEALLSGEGDRRA APARPAGSLSPEDLG | 1083 | 66/163 (40%) |

TABLE 13-continued

Conserved bHLH-MYC_N domain ("domain 1") of AtMYC1 and closely related sequences

| Col. 1 SEQ ID NO: | Col. 2 Species/ Identifier | Col. 3 Percent identity of polypeptide in Col. 1 to AtMYC1 | Col. 4 bHLH-MYC_N domain in amino acid coordinates | Col. 5 Conserved bHLH-MYC_N domain sequence | Col. 6 SEQ ID NO: of bHLH-MYC_N domain | Col. 7 Percent identity of first bHLH-MYC_N domain in Col. 5 to the bHLH-MYC_N domain of AtMYC1 |
|---|---|---|---|---|---|---|
| | | | | DTEWYYVVSMTYAFR PGQGLPGRSFASDEH VWLCNAHLAGSKAFP RALLAKSILCIPVMG GVLELGTTDTVPEAP DLVSRATAAF | | |
| 1028 | GRMZM5G822 829_T03 | 87/204 (42%) | 24-204 | MRSQLAAAARSINWS YALFWSISDTQPGVL TWTDGFYNGEVKTRK ISNSVELTSDHLVMQ RSDQLRELYEALLSG EGDRRAAPARPAGSL SPEDLGDTEWYYVVS MTYAFRPGQGLPGRS FASDEHVWLCNAHLA GSKAFPRALLAKSIL CIPVMGGVLELGTTD TVPEAPDLVSRATAA F | 1085 | 85/191 (44%) |
| 1030 | Si000845m | 166/573 (28%) | 18-196 | LRNHLAAAVRSINWT YALFWSISSTQPGFL TWTDGFYNGEVKTRK IVNSAELTADQLVMQ RSEQLRELYEALLSG ECDRRAARPVASLSP EDLGDTELYYVVCMT YAFRPGQGLPGRSFA SNERVWMWNSHLADS KAFPRALLAKTIVCI PLMSGVLELGTTDAV VEDPSLVSRATASF | 1087 | 79/191 (41%) |
| 1032 | Si012401m | 145/520 (28%) | 1-138 | FLTWTDGFYNGEVKT RKIANSAELTADQLV MQRSEQLRELYEALL SGECDRRTARPVASL SPEDLGDTEWYYVVC MTYAFRPGQGLPGRS FASNERVWMRNSHLA DSKAFPRALLAKTIV CIPFMSGVLELGTTD AEP | 1089 | 58/153 (37%) |
| 1034 | AT1G63650.1 | 105/217 (48%) | 13-202 | LKKQLAVSVRNIQWS YGIFWSVSASQPGVL EWGDGYYNGDIKTRK TIQAAEVKIDQLGLE RSEQLRELYESLSLA ESSASGSSQVTRRAS AAALSPEDLTDTEWY YLVCMSFVFNIGEGI PGGALSNGEPIWLCN AETADSKVFTRSLLA KSASLQTVVCFPFLG GVLEIGTTEHIKEDM NVIQSVKTLF | 1091 | 102/198 (51%) |
| 1036 | AT5G41315.1 | 101/202 (50%) | 14-206 | LKKHLAVSVRNIQWS YGIFWSVSASQSGVL EWGDGYYNGDIKTRK TIQASEIKADQLGLR RSEQLSELYESLSVA | 1093 | 100/198 (50%) |

TABLE 13-continued

Conserved bHLH-MYC_N domain ("domain 1") of AtMYC1 and closely related sequences

| Col. 1 SEQ ID NO: | Col. 2 Species/ Identifier | Col. 3 Percent identity of polypeptide in Col. 1 to AtMYC1 | Col. 4 bHLH-MYC_N domain in amino acid coordinates | Col. 5 Conserved bHLH-MYC_N domain sequence | Col. 6 SEQ ID NO: of bHLH-MYC_N domain | Col. 7 Percent identity of first bHLH-MYC_N domain in Col. 5 to the bHLH-MYC_N domain of AtMYC1 |
|---|---|---|---|---|---|---|
| | | | | ESSSSGVAAGSQVTR RASAAALSPEDLADT EWYYLVCMSFVFNIG EGMPGRTFANGEPIW LCNAHTADSKVFSRS LLAKSAAVKTVVCFP FLGGVVEIGTTEHIT EDMNVIQCVKTSF | | |
| 1038 | clementine 0.9_0_04500m | 129/243 (53%) | 15-198 | LRKQLAVAVRSIQWS YAIFWSLSAAQQGVL EWGDGYYNGDIKTRK TMQAMELTPDKIGLQ RSKQLRELYESLLKG ESELAYKRPSAALSP EDLTDAEWYYLVCMS FVFSSGQGLPGRALA NSETIWLCNAQCADS KVFSRSLLAKSASIQ TVICFPHLDGVIELG VTELVPEDPSLLQHI KASL | 1095 | 120/198 (60%) |
| 1040 | clementine 0.9_005551m | 123/313 (39%) | 1-139 | MQFSGHYQLHNKGLQ RSKQLRELYESLLKG ESELAYKRPSAALSP EDLTDAEWYYLVCMS FVFSSGQGLPGRALA NSETIWLCNAQCADS KVFSRSLLAKSASIQ TVICFPHLDGVIELG VTELVPEDPSLLQHI KASL | 1097 | 86/151 (56%) |
| 1042 | clementine 0.9_005579m | 123/313 (39%) | 1-138 | MQAMELTPDKIGLQR SKQLRELYESLLKGE SELAYKRPSAALSPE DLTDAEWYYLVCMSF VFSSGQGLPGRALAN SETIWLCNAQCADSK VFSRSLLAKSASIQT VICFPHLDGVIELGV TELVPEDPSLLQHIK ASL | 1099 | 85/143 (59%) |
| 1044 | Eucgr. D02287.1 | 128/220 (58%) | 15-198 | LRKQLAVAVRSIQWS YAIFWTLSATKQGVL QWGDGYYNGDIKTRK TVQAVELKPDKIGLQ RSEQLRDLYESLLEG ETDAQNKRPSAALSP EDLTDEEWYYLVCMS FVFNPGEGLPGRALA DGQTIWLCNAQYADS KVFSRSLLAKSASIQ TVVCFPYLGGVIELG VTELVPEDPSLLQHI KVSL | 1101 | 121/198 (61%) |
| 1046 | Glyma03g 01180.1 | 111/224 (49%) | 16-202 | LCTQLAVAVRSIQWS YGIFWSPSTTEERVL EWREGYYNGDIKTRK TVQATELEIKADKIG LQRSEQLKELYKFLL | 1103 | 105/200 (52%) |

TABLE 13-continued

Conserved bHLH-MYC_N domain ("domain 1") of AtMYC1 and closely related sequences

| Col. 1 SEQ ID NO: | Col. 2 Species/ Identifier | Col. 3 Percent identity of polypeptide in Col. 1 to AtMYC1 | Col. 4 bHLH-MYC_N domain in amino acid coordinates | Col. 5 Conserved bHLH-MYC_N domain sequence | Col. 6 SEQ ID NO: of bHLH-MYC_N domain | Col. 7 Percent identity of first bHLH-MYC_N domain in Col. 5 to the bHLH-MYC_N domain of AtMYC1 |
|---|---|---|---|---|---|---|
| | | | | AGEADHPQTKRPSVA LAPEDLSDLEWYYLV CMSFVFNHNQSLPGR ALEIGDTVWLCNAQH ADSKVFSRSLLAKSA TIQTVVCFPYQKGVI EIGTTELVAEDPSLI QHVKACF | | |
| 1048 | Glyma07g 07740.1 | 104/215 (48%) | 16-196 | LCTQLAVAVRSTQWS YGIFWAPSTTEERVL EWREGYYNGDIKTRK TVQAMELEMKADKIG LQRSEQLKELYKFLL AGEADPQTKRPSAAL APEDLSDLEWYYLVC MSFVFNHNQSLPGRA LEIGDTVWLCNAQHA DSKIFSRSLLAKTVV CFPYQKGVIEIGTTE LVTEDPSLIQHVKAC F | 1105 | 100/200 (50%) |
| 1050 | POPTR_0002s 16080.1 | 133/230 (57%) | 15-197 | LRKQLAIAVRSVQWS YAIFWSLSTRQKGVL EWGGGYYNGDIKTRK VQATELKADKIGLQR SEQLRELYKSLLGGD AGQQAKRSSPALSPE DLSDEEWYYLVCMSF VFNPGEGLPGRALAN KQTIWLCNAQYADSK VFSRSLLAKSASIQT VVCFPYLEGVMELGV TELVTEDPSLIQHIK ASL | 1107 | 123/197 (62%) |
| 1052 | POPTR_0014s 07960.1 | 131/230 (56%) | 15-197 | LRKQLAVAVRSVQWS YAVFWSQSTRQQGVL EWGDGYYNGDIKTRK VEAMELKADKIGLQR SEQLRELYESLLEGE TGLQATRSSPALSPE DLSDEEWYYLVCMSF VFNPGEGLPGRALAN KQPIWLCNAQYADSK VFSRSLLAKSASIQT VVCFPYLEGVIELGV TELVTEDPGLIQHIK ASL | 1109 | 122/197 (61%) |
| 1054 | GSVIVT010 26927001 | 126/220 (57%) | 15-198 | LSKQLAVAVRSIQWS YAIFWSLSTRQQGVL EWSGGYYNGDIKTRK TVQEMELKADKMGLQ RSEQLRELYESLLEG ETDQQSKRPSAALSP EDLSDAEWYYLVCMS FVFNPGEGLPGRALA NGQSIWLCDAQYADS KVFSRSLLAKSASIQ TVVCFPHMGGVIELG VTELVPEDPSLIQHI KACL | 1111 | 119/198 (60%) |

TABLE 13-continued

Conserved bHLH-MYC_N domain ("domain 1") of AtMYC1 and closely related sequences

| Col. 1 SEQ ID NO: | Col. 2 Species/ Identifier | Col. 3 Percent identity of polypeptide in Col. 1 to AtMYC1 | Col. 4 bHLH-MYC_N domain in amino acid coordinates | Col. 5 Conserved bHLH-MYC_N domain sequence | Col. 6 SEQ ID NO: of bHLH-MYC_N domain | Col. 7 Percent identity of first bHLH-MYC_N domain in Col. 5 to the bHLH-MYC_N domain of AtMYC1 |
|---|---|---|---|---|---|---|
| 1056 | Solyc08g 0811402.1 | 112/201 (55%) | 15-202 | LRKQLALAVRGIQWS YAIFWSTAVTQPGVL KWIDGYYNGDIKTRK TVQAGEVNEDQLGLH RTEQLKELYSSLLTS ESEEDLQPQAKRPSA SLSPEDLTDTEWYFL VCMSFVFNVGQGLPG KTLATNETVWLCNAH QAESKVFSRSLLAKS ASIQTVVCFPYLGGV IELGVILLVTEDPNL IQQIKNSF | 1113 | 111/196 (56%) |
| 1058 | GSVIVT010 19750001 | 212/546 (38%) | 14-197 | LRNQLALAVRNIQWS YAIFWSISTRQPGVL EWGDGYYNGDIKTRK TVQAVEFNADQMGLQ RSEQLRELYESLSIG ESNPQPRRHSAALSP EDLTDAEWYYLVCMS FVFDIGQGLPGRTLA SGQPIWLCNAPYAES KVFSRSLLAKSASIQ TVVCFPYLGGVIELG ATEMVLEDPSLIQHI KTSF | 1115 | 115/196 (58%) |
| 1060 | Eucgr. D01841.1 | 109/201 (54%) | 15-198 | LKKQLALAVRKIQWS YGIFWSISTRQPGVL EWGDGYYNGDIKTRK TIQAVELNTDQIGMQ RSEQLRELYESLSAG ESSPQVRRPSAALSP EDLTDAEWYYLVCMS FIYDIGQGLPGRTLT TGQPTWLCNAHYADS KVFTRSLLAKSASIQ TVVCFPFRGGVIELG VTDQVSEDPGVIHQV KGTL | 1117 | 107/198 (54%) |
| 1062 | Eucgr. E00624.1 | 74/144 (51%) | 1-141 | MTQAIELNGGDHMDL HRSEQLRELYESLSG SEPNPQTSRRPSVAL SPEDLADAEWYYLVC MSFIFNIGQCLPGQS LATGKLIWLCNAHCA DSKVFSRSLLAKSAS IQTVVCFPPLDGVIE LGTTDPVLEDPNLIQ HVKTYL | 1119 | 72/140 (51%) |
| 1064 | Glyma05g 37770.1 | 105/206 (50%) | 6-184 | LKKQLALAVRSIHWS YAIFWTDSTTQPGVL SWGEGYYNGDIKTRK TSQGVELNSDQIGLQ RSEQLRELFKSLKTV EVSPQTKRPSAALSP EDLTDAEWYYLVCMS FIFNIGQGLPGRTLA KGQSIWLNNAHSADC KIFSRSLLAKTVVCF | 1121 | 102/196 (52%) |

TABLE 13-continued

Conserved bHLH-MYC_N domain ("domain 1") of AtMYC1 and closely related sequences

| Col. 1 SEQ ID NO: | Col. 2 Species/ Identifier | Col. 3 Percent identity of polypeptide in Col. 1 to AtMYC1 | Col. 4 bHLH-MYC_N domain in amino acid coordinates | Col. 5 Conserved bHLH-MYC_N domain sequence | Col. 6 SEQ ID NO: of bHLH-MYC_N domain | Col. 7 Percent identity of first bHLH-MYC_N domain in Col. 5 to the bHLH-MYC_N domain of AtMYC1 |
|---|---|---|---|---|---|---|
| | | | | PFREGVIELGTTEQV SEDLSVIERIKTSF | | |
| 1066 | Glyma08g 01810.1 | 104/199 (52%) | 6-190 | LKKQLALAVRSIHWS YAIFWTDSTTQPGVL SWGEGYYNGDIKTRK TSQGVELNSDQIGLQ RSEQLRELFKSLKTV EVTPQTKRPSAAALS PEDLTDAEWYYLVCM SFIFNIGQGLPGRTL AKGQPIWLNNAHSSD CKIFSRSLLAKSASI ETVVCFPFREGVIEL GTTEQVPEDLSVIEL IKTSF | 1123 | 104/196 (53%) |
| 1068 | clementine 0.9_005250m | 124/272 (45%) | 16-196 | LKKQLALAVRSIQWS YAIFWTISDTQPGVL EWGDGYYNGDIKTRK TIQSVELSSNQLGLQ RSEQLRELYESLSAG ESHPQAASKRPSAAL SPEDLTDTEWYYLVC MSFNFNIGEGLPGRA LANNQPIWLCNAQYA DSKVFSRSLLAKTVV CFPHLGVVELGVTE LVLEEPDFIQHIKTS F | 1125 | 108/196 (55%) |
| 1070 | POPTR_0001s 09450.1 | 110/201 (54%) | 15-198 | LKKQLAIAVRSIQWS YAIFWSMSARQPGVL EWGDGYYNGDIKTRK TIQSIELDEDELGLQ RSEQLRELYESLSVG EASPQARRPSAALSP EDLTDTEWYYLVCMS FIFDIGQGLPGTTLA NGHPTWLCNAHSADS KVFSRSLLAKSASIQ TVVCFPFMRGVIELG VTEQVLEDPSLINHI KTSF | 1127 | 108/196 (55%) |
| 1072 | POPTR_0003s 12810.1 | 103/201 (51%) | 15-193 | LKKQLALAVRSIQWS YAIFWSNPTGQPGVL EWADGYYNGDIKTRK TVQSIELNADELGLQ RSEQLRELYESLSAG EANPQARRPSAALSP EDLTDTEWYYLVCMS FVFDNGQGLPGTTLA NGHPTWLCNAPSADS KIFSRSLLAKTVVCF PFMRGVVELGVSEQV LEDPSLIQHIKTSF | 1129 | 101/196 (51%) |

TABLE 14

Conserved HLH domain ("domain 2") of AtMYC1 and closely related sequences

| Col. 1 SEQ ID NO: | Col. 2 Species/ Identifier | Col. 3 Percent identity of polypeptide in Col. 1 to AtMYC1 | Col. 4 HLH domain (conserved domain 2) in amino acid coordinates | Col. 5 Conserved HLH domain (domain 2) | Col. 6 SEQ ID NO: of the conserved HLH domain | Col. 7 Percent identity of the HLH domains in Col. 5 to the HLH domain of AtMYC1 |
|---|---|---|---|---|---|---|
| 1016 | At/AtMYC1 or AT4G00480.1 | 526/526 (100%) | | SQNSGLNQDDPSDRR KENEKFSVLRTMVPT VNEVDKESILNNTIK YLQELEARVEE | 1074 | 100% (44/44) |
| 1020 | Os/LOC_Os04 g47040.1 | 92/201 (45%) | 370-435 | RGSRAALTQESGIKN HVISERRRREKLNEM FLILKSIVPSIHKVD KASILEETIAYLKVL EKRVKE | 1078 | 28/63 (44%) |
| 1022 | Os/LOC_Os04 g47080.1 | 90/201 (44%) | 383-450 | GDSSAAAMTTQGSSI KNHVMSERRRREKLN EMFLILKSVVPSIHR VDKASILAETIAYLK ELEKRVEE | 1080 | 28/59 (47%) |
| 1024 | Zm/GRMZM2 G172795_T01 | 158/564 (28%) | 363-431 | NCGGGGTTVTAQENG AKNHVMLERKRREKL NEMFLVLKSLVPSIH KVDKASILAETIAYL KELQRRVQE | 1082 | 24/43 (55%) |
| 1026 | Zm/GRMZM5 G822829_T01 | 67/172 (38%) | 375-442 | GGATGAAQEMSGTGT KNHVMSERKRREKLN EMFLVLKSLLPSIHR VNKASILAETIAYLK ELQRRVQE | 1084 | 22/43 (51%) |
| 1028 | Zm/GRMZM5 G822829_T03 | 87/204 (42%) | 400-467 | GGATGAAQEMSGTGT KNHVMSERKRREKLN EMFLVLKSLLPSIHR VNKASILAETIAYLK ELQRRVQE | 1086 | 22/43 (51%) |
| 1030 | Si/Si000845m | 166/573 (28%) | 395-425 | GGGGTTRMAQESGVK NHVMSERKRREKLNE MFLVLKSLVPSIHKV DKASILAETIAYLKE LQRRVQE | 1088 | 30/65 (46%) |
| 1032 | Si/Si012401m | 145/520 (28%) | 289-355 | GGGGTTRMAQESGVK NHVMSERKRREKLNE MFLVLKSLVPSIHKV DKASILAETIAYLKE LQRRVQE | 1090 | 30/65 (46%) |
| 1034 | At/AT1G6365 0.1 | 105/217 (48%) | 393-456 | EELLPDTPEETGNHA LSEKKRREKLNERFM TLRSIIPSISKIDKV SILDDTIEYLQDLQK RVQE | 1092 | 22/43 (51%) |
| 1036 | At/AT5G4131 5.1 | 101/202 (50%) | 426-492 | EKLMLDSPEARDETG NHAVLEKKRREKLNE RFMTLRKIIPSINKI DKVSILDDTIEYLQE LERRVQE | 1094 | 25/43 (58%) |
| 1038 | Cc/clementine 0.9_004500m | 129/243 (53%) | 440-509 | SQKEICRKYCPVTME SDNFCEEHISSDKRT ENEKFMVLRSMVPYI SEVDKASILSDTIKY LKKLEARVEE | 1096 | 33/45 (73%) |

TABLE 14-continued

Conserved HLH domain ("domain 2") of AtMYC1 and closely related sequences

| Col. 1 SEQ ID NO: | Col. 2 Species/ Identifier | Col. 3 Percent identity of polypeptide in Col. 1 to AtMYC1 | Col. 4 HLH domain (conserved domain 2) in amino acid coordinates | Col. 5 Conserved HLH domain (domain 2) | Col. 6 SEQ ID NO: of the conserved HLH domain | Col. 7 Percent identity of the HLH domains in Col. 5 to the HLH domain of AtMYC1 |
|---|---|---|---|---|---|---|
| 1040 | Cc/clementine 0.9_005551m | 123/313 (39%) | 381-450 | SQKEICRKYCPVTME SDNFCEEHISSDKRT ENEKFMVLRSMVPYI SEVDKASILSDTIKY LKKLEARVEE | 1098 | 33/45 (73%) |
| 1042 | Cc/clementine 0.9_005579m | 123/313 (39%) | 380-449 | SQKEICRKYCPVTME SDNFCEEHISSDKRT ENEKFMVLRSMVPYI SEVDKASILSDTIKY LKKLEARVEE | 1100 | 33/45 (73%) |
| 1044 | Eg/Eucgr. D02287.1 | 128/220 (58%) | 437-503 | SELQNGVESLLGDVD FCAGHILSTKKKEHE KFLVLRSMIPSIEEI DKASILDDTIMYLRE LEARVEE | 1102 | 29/45 (64%) |
| 1046 | Gm/Glyma03g 01180.1 | 111/224 (49%) | 405-476 | SQKGNDRMEWTSKLE NDDHGLIGKAFSDKK REIKNFQVVKSMVPS SISEVEKISILGDTI KYLKKLETRVEE | 1104 | 25/46 (54%) |
| 1048 | Gm/Glyma07g 07740.1 | 104/215 (48%) | 405-476 | SQKENGRMKWTSKLE NANDGFMEKTFSDKK RENKNFHVVKPMVPS SISEVEKISILGDTI KYLKKLETRVEE | 1106 | 28/55 (50%) |
| 1050 | Pt/POPTR_00 02s16080.1 | 133/230 (57%) | 437-506 | FDKENGGTDCLKKLE GCETCKEHYKSDKQR VNDKFIVLRSMVPSI SEIDKESILSDTINY LKQLESRVAE | 1108 | 27/45 (60%) |
| 1052 | Pt/POPTR_00 14s07960.1 | 131/230 (56%) | 438-507 | SDKENAGKDCLKNLE GCETCKLHFLSEKQK ENEKYLALESIVASI NEIDKASILSDTINY PRQLESRVAE | 1110 | 23/45 (51%) |
| 1054 | Vv/GSVIVT0 1026927001 | 126/220 (57%) | 420-489 | SQKENAGRDGLWKSG SDGICKQHALSDKKR EKEKFLVLRSMVPSI NKIDEVSILGDTIEY LKKLEARVEE | 1112 | 31/60 (51%) |
| 1056 | Sl/Solyc08g08 1140.2.1 | 112/201 (55%) | 415-487 | FSRENGKKNSLWRPE VDDIDRNRVISERRR REKERFMHLASMLPT SSKVDKISLLDETIE YMKELERRVQE | 1114 | 23/43 (53%) |
| 1058 | Vv/GSVIVT0 1019750001 | 212/546 (38%) | 323-395 | SRDNNGDNDEIWRPE ADEITLNHVLSERKR REKINERFSVLRSLV PSINQVNKVSVLDDT IEYLKELKRRVEE | 1116 | 26/43 (60%) |
| 1060 | Eg/Eucgr.D01 841.1 | 109/201 (54%) | 411-483 | SPLEDGGENGVWRPE ADEIGLNHAILERKQ KEKINDRLGVLKSMV PSVSKVDKLSILDDT IAYLRELQRKVEE | 1118 | 27/54 (50%) |

TABLE 14-continued

Conserved HLH domain ("domain 2") of AtMYC1 and closely related sequences

| Col. 1 SEQ ID NO: | Col. 2 Species/ Identifier | Col. 3 Percent identity of polypeptide in Col. 1 to AtMYC1 | Col. 4 HLH domain (conserved domain 2) in amino acid coordinates | Col. 5 Conserved HLH domain (domain 2) | Col. 6 SEQ ID NO: of the conserved HLH domain | Col. 7 Percent identity of the HLH domains in Col. 5 to the HLH domain of AtMYC1 |
|---|---|---|---|---|---|---|
| 1062 | Eg/Eucgr.E00 624.1 | 74/144 (51%) | 343-415 | ISKVSCKRDGLWMAL TDELSPDHTLSESRQ REKINEQFSVLNSIL PLVNKVDKISILDNT IEYVKELQRRAEE | 1120 | 26/43 (60%) |
| 1064 | Gm/Glyma05g 37770.1 | 105/206 (50%) | 406-477 | SQEENDYKEGMRVEA DENGMNHVMSERRRR AKLNQRFLTLRSMVP SISKDDKVSILDDAI EYLKKLERRINE | 1122 | 21/43 (48%) |
| 1066 | Gm/Glyma08g 01810.1 | 104/199 (52%) | 412-483 | SQEENDYKEGMRVEA DENGMNHVMSERRRR AKLNERFLTLRSMVP SISKDDKVSILDDAI DYLKKLERRVKE | 1124 | 23/43 (53%) |
| 1068 | Cc/clementine 0.9_005250m | 124/272 (45%) | 419-491 | SSEDNHIKDDVSRLE AEETATNHVKSERRQ RGKLNERFVILKSMV PSVSKFDKVSILDDT IEYVQELERKVKE | 1126 | 24/43 (55%) |
| 1070 | Pt/POPTR_00 01s09450.1 | 110/201 (54%) | 410-487 | SPEYNSNKVVVGRPE ADENGASHALSERKQ REKLNKRFMILKSIV PSISKVVDKVSILDE TIEYLQELERKVEE | 1128 | 24/44 (54%) |
| 1072 | Pt/POPTR_00 03s12810.1 | 103/201 (51%) | 407-479 | SPEYSSDKVVGGRPE ADEIGASHVLSERRR REKLNKRFMILKSIV PSISKVDKVSILDDT IQYLQELERKVEE | 1130 | 24/43 (55%) |

Species abbreviations for Tables 13 and 14:
At—*Arabidopsis thaliana*;
Cc—*Citrus clementina*;
Eg—*Eucalyptus grandis*;
Gm—*Glycine max*;
Os—*Oryza sativa*;
Pt—*Populus trichocarpa*;
Si—*Setaria italica*;
Sl—*Solanum lycopersicum*;
Vv—*Vitis vinifera*;
Zm—*Zea mays*

Sequences that are functionally-related and/or closely-related to the polypeptides in Tables 13 and 14 may be created artificially, semi-synthetically, or may occur naturally by having descended from the same ancestral sequence as the disclosed AtMYC1-related sequences, where the polypeptides have the function of conferring increased photosynthetic resource use efficiency to plants.

As shown in FIG. 21A-21O, these "functionally-related and/or closely-related" AtMYC1 clade polypeptides generally contain a consensus sequence of the AtMYC1 clade, SEQ ID NO: 1153:

$X^1$-$X^2$-x-x-x-L-A-x-$X^3$-x-R-x-x-x-W-$X^4$-Y-$X^5$-$X^6$-F-W-

$X^7$-x-x-x-x-x-x-x-L-x-W-x-x-G-x-Y-N-G-x-$X^8$-K-

-continued $X^9$-R-K-$X^{10}$-x-x-x-$X^{11}$-$X^{12}$-$X^{13}$-$X^{14}$-$X^{15}$-x-x-x-x-x-$X^{16}$- x-x-$X^{17}$-x-$X^{18}$-L-x-x-L-$X^{19}$-x-x-$X^{20}$-x-x-x-$X^{21}$-x-x-$X^{22}$-

$X^{23}$-$X^{24}$-$X^{25}$-x-x-x-x-$X^{26}$-$X^{27}$-$X^{28}$-$X^{29}$-$X^{30}$-$X^{31}$-$X^{32}$-$X^{33}$-

$X^{34}$-$X^{35}$-$X^{36}$-$X^{37}$-$X^{38}$-x-x-x-x-x-$X^{39}$-x-x-L-x-P-$X^{40}$-D-

L-$X^{41}$-D-x-E-x-Y-$X^{42}$-$X^{43}$-$X^{44}$-$X^{45}$-M-$X^{46}$-$X^{47}$-x-$X^{48}$-x-x- x-$X^{49}$-x-$X^{50}$-P-G-x-$X^{51}$-x-x-x-x-x-$X^{52}$-W-$X^{53}$-x-$X^{54}$-

$X^{55}$-x-x-$X^{56}$-x-x-K-x-F-x-R-$X^{57}$-L-$X^{58}$-A-$X^{59}$-$X^{60}$-$X^{61}$-

-continued $$X^{62}-X^{63}-x-X^{64}-X^{65}-X^{66}-C-x-P-x-X^{67}-x-x-G-V-X^{68}-E-X^{69}-$$
$$G-x-X^{70}-X^{71}-x-X^{72}-x-E$$

In the above consensus sequences of SEQ ID NO: 1153, x represents any amino acid; $X^1$ represents Phe or Leu; $X^2$ represents any amino acid or absent; $X^3$ represents Ala or Serine; $X^4$ represents Thr or Ser; $X^5$ represents Gly, Ala, or Ser; $X^6$ represents Ile, Val, Leu, or Met; $X^7$ represents Ser, Ala, or Thr; represents Ile, Val, Leu or Met; $X^9$ represents Thr or Lys; $X^{10}$, $X^{11}$, $X^{12}$, and $X^{13}$ represents any amino acid or absent; $X^{14}$ represents Glu or absent; $X^{15}$ represents Ile, Met, or absent; $X^{16}$ represents Ile, Val, Leu or Met; $X^{17}$ represents Ser or Thr; $X^{18}$ represents Gln or Glu; $X^{19}$ represents Tyr or Phe; $X^{20}$ represents Ile, Val, Leu or Met; $X^{21}$ represents Glu or Asp; $X^{22}$-$X^{25}$ and $X^{26}$-$X^{38}$ represent any amino acid or absent; $X^{39}$ represents Ala, Ser, or absent; $X^{40}$ represents Glu or Asp; $X^{41}$ represents Gly, Ala, Ser or Thr; $X^{42}$ represents Tyr or Phe; $X^{43}$ and $X^{44}$ represent Ile, Val, Leu or Met; $X^{45}$ represents Cys or Ser; $X^{46}$ represents Ser or Thr; $X^{47}$ and $X^{48}$ represent Tyr or Phe; $X^{49}$ represents Gln or Glu; $X^{50}$ represents Ile, Val, Leu or Met; $X^{51}$ represents Thr, Ala, or Ser; $X^{52}$ represents Ile, Val, Leu, Met, or Thr; $X^{53}$ represents Ile, Val, Leu, or Met; $X^{54}$ represents Asp or Asn; $X^{55}$ represents Ala or Ser; $X^{56}$ and $X^{57}$ represent Ala or Ser; $X^{58}$ represents Ile, Val, Leu, or Met; $X^{59}$ represents Lys or Arg; $X^{60}$ represents Ser or absent; $X^{61}$ represent Ala or absent; $X^{62}$ represents Ser, Ala, Thr, or absent; $X^{63}$ represents Ile, Val, Leu, Met, or absent; $X^{64}$ represents Ser or Thr; $X^{65}$ and $X^{66}$ represent Ile, Val, Leu, or Met; $X^{67}$ represents any amino acid or absent; $X^{68}$ represents Ile, Val, Leu, or Met; $X^{69}$ represents Ile, Val, Leu, Met, or Phe; $X^{70}$ represents Ser or Thr; $X^{71}$ represents Glu or Asp; $X^{72}$ represents Ile, Val, Leu, or Met.

As shown in FIG. 21K, these "functionally-related and/or closely-related" AtMYC1 clade polypeptides also generally contain a consensus sequence SEQ ID NO: 1154:

$$S-X^1-L-x-X^2-X^3-I-x-Y-x-x-L-X^1-x-x-X^4-X^1-E-L$$

In the above consensus sequences of SEQ ID NO: 1154, x represents any amino acid; $X^1$ is Ile, Val, Leu, or Met; $X^2$ is Glu, Asp, or Asn; $X^3$ is Thr or Ala; and $X^4$ is Arg or Lys.

Alternative consensus sequences comprising the above with conservative substitutions found in Table 1 are also envisaged and may be expected to provide equivalent function(s).

The presence of one or more of these consensus sequences and/or these amino acid residues is correlated with conferring of improved or increased photosynthetic resource use efficiency to a plant when the expression level of the polypeptide is altered in a plant by being reduced, knocked-out, or overexpressed. An AtMYC1 clade polypeptide sequence that is "functionally-related and/or closely-related" to the listed full length protein sequences or domains provided in Tables 13 or 14 may also have at least 28%, 38%, 39%, 42%, 43%, 44%, 45%, 46%, 47%, 48%, 49%, 50%, 51%, 52%, 53%, 54%, 55%, 56%, 58%, 57%, 58%, 80%, 85%, 86%, 87%, 88%, 89%, 90%, 91%, 92%, 93%, 94%, 95%, 96%, 97%, 98%, 99%, or about 100% amino acid identity to SEQ ID NO: 1016 or to the entire length of a listed full length sequence of SEQ ID NO: 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, and/or at least 37%, 40%, 41%, 44%, 45%, 46%, 47%, 50%, 51%, 52%, 53%, 54%, 55%, 56%, 58%, 59%, 60%, 61%, 62%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% amino acid identity to the listed bHLH-MYC_N domains, i.e., SEQ ID NO: 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, or 1129, and/or at least 44%, 46%, 47%, 48%, 49%, 50%, 51%, 52%, 53%, 54%, 55%. 56%, 58%, 60%, 64%, 73%, 75%, 80%, 85%, 86%, 87%, 88%, 89%, 90%, 91%, 92%, 93%, 94%, 95%, 96%, 97%, 98%, 99%, or about 100% amino acid identity to the listed HLH domains, i.e., 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, or 1130. The presence of the disclosed conserved bHLH-MYC_N domain and/or conserved HLH domain in the polypeptide sequence (for example, SEQ ID NO: 1073-1130), is correlated with the conferring of improved or increased photosynthetic resource use efficiency to a plant when the expression level of the polypeptide is altered in a plant by being reduced, knocked-out, or overexpressed. All of the sequences that adhere to these functional and sequential relationships are herein referred to as "AtMYC1 clade polypeptides" or "AtMYC1 clade polypeptides", or which fall within the "AtMYC1 clade" or "G581 clade" exemplified in the phylogenetic tree in FIG. 20 as those polypeptides bounded by LOC_Os01g39560.1 and POPTR_0003s12810.1 (indicated by the box around these sequences).

TABLE 15

Conserved first WRKY domain of WRKY3 and closely related sequences

| Col. 1 SEQ ID NO: | Col. 2 Species/ Identifier | Col. 3 Percent identity of polypeptide in Col. 1 to WRKY3 | Col. 4 WRKY domain 1 in amino acid coordinates | Col. 5 Conserved WRKY domain 1 | Col. 6 SEQ ID NO: of WRKY domain 1 | Col. 7 Percent identity of first WRKY in Col. 5 to WRKY domain 1 of WRKY3 |
|---|---|---|---|---|---|---|
| 1156 | At/WRKY3 or AT2G03340.1 | 100% (513/513) | 249-305 | ADDGYNWRKYGQKQV KGSDFPRSYYKCTHP ACPVKKKVERSLDGQ VTEIIYKGQHNH | 1227 | 100% (57/57) |

TABLE 15-continued

Conserved first WRKY domain of
WRKY3 and closely related sequences

| Col. 1 SEQ ID NO: | Col. 2 Species/ Identifier | Col. 3 Percent identity of polypeptide in Col. 1 to WRKY3 | Col. 4 WRKY domain 1 in amino acid coordinates | Col. 5 Conserved WRKY domain 1 | Col. 6 SEQ ID NO: of WRKY domain 1 | Col. 7 Percent identity of first WRKY in Col. 5 to WRKY domain 1 of WRKY3 |
|---|---|---|---|---|---|---|
| 1190 | Pt/POPTR_0 008s09140.1 | 55% (297/540) | 221-277 | TDDGYNWRKYGQKQV KGSEFPRSYYKCTHP NCPVKKKVERSLDGQ VTEIIYKGQHNH | 1261 | 96% (54/56) |
| 1158 | At/AT1G139 60.1 | 68% (370/541) | 228-284 | ADDGYNWRKYGQKQV KGSEFPRSYYKCTNP GCPVKKKVERSLDGQ VTEIIYKGQHNH | 1229 | 94% (54/57) |
| 1172 | Vv/GSVIVT 01001332001 | 59% (277/467) | 225-281 | ADDGYNWRKYGQKQV KGSEYPRSYYKCTHP SCPVKKKVERSLDGQ VTEIIYKGQHNH | 1243 | 94% (54/57) |
| 1182 | Eg/Eucgr.G0 2469.1 | 52% (255/495) | 248-304 | ADDGYNWRKYGQKQV KGSEFPRSYYKCTHP TCPVKKKVERSLDGQ ITEIIYKGQHNH | 1253 | 94% (54/57) |
| 1174 | Sl/Solyc05g 012770.2.1 | 53% (291/552) | 215-271 | ADDGYNWRKYGQKQV KGSEYPRSYYKCTNP NCPVKKKVERSLDGQ VTEIIYKGQHNH | 1245 | 92% (53/57) |
| 1192 | Pt/POPTR_0 010s17040.1 | 57% (302/532) | 222-278 | ANDGYNWRKYGQKQV KGSEYPRSYYKCTHP NCPVKKKVERSLDGQ VTEIIYKGQHNH | 1263 | 92% (53/57) |
| 1196 | Cc/clementine 0.9_007348m | 61% (326/538) | 249-305 | ADDPYNWRKYGQKHV KGSEFPRSYYKCTHP NCPVKKKVERSLDGQ VTEIIYKGQHNH | 1267 | 92% (53/57) |
| 1180 | Eg/Eucgr.B0 3189.1 | 53% (291/544) | 246-302 | ADDGYNWRKYGQKQV KGSEFPRSYYKCTHP DCPVRKKVERSLDGH ITEIIYKGQHNH | 1251 | 91% (52/57) |
| 1160 | Gm/Glyma0 1g06550.1 | 51% (265/519) | 174-230 | ADDGYNWRKYGQKQV KGSEFPRSYYKCTHP NCSVKKKVERSLEGH VTAIIYKGEHNH | 1231 | 87% (50/57) |
| 1162 | Gm/Glyma0 2g12490.1 | 51% (268/521) | 174-230 | ADDGYNWRKYGQKQV KGSEFPRSYYKCTNP NCPVKKKVERSLEGH VTAIIYKGEHNH | 1233 | 87% (50/57) |
| 1188 | Pt/POPTR_0 017s12430.1 | 50% (281/561) | 237-294 | THDGYNWRKYGQKPI KGSEYPRSYYKCTHL NCPVKKKVERSSDGQ ITEIIYKGQHNH | 1259 | 85% (47/55) |
| 1168 | Gm/Glyma0 8g26230.1 | 52% (278/533) | 228-284 | ADDGYNWRKYGQKQV KGSEYPRSYYKCTHL NCVVKKKVERAPDGH ITEIIYKGQHNH | 1239 | 84% (48/57) |
| 1170 | Gm/Glyma1 8g49830.1 | 53% (281/529) | 226-282 | ADDGYNWRKYGQKQV KGSEYPRSYYKCTHL NCVVKKKVERAPDGH ITEIIYKGQHNH | 1241 | 84% (48/57) |

TABLE 15-continued

Conserved first WRKY domain of
WRKY3 and closely related sequences

| Col. 1 SEQ ID NO: | Col. 2 Species/ Identifier | Col. 3 Percent identity of polypeptide in Col. 1 to WRKY3 | Col. 4 WRKY domain 1 in amino acid coordinates | Col. 5 Conserved WRKY domain 1 | Col. 6 SEQ ID NO: of WRKY domain 1 | Col. 7 Percent identity of first WRKY in Col. 5 to WRKY domain 1 of WRKY3 |
|---|---|---|---|---|---|---|
| 1202 | Os/LOC_Os 12g32250.1 | 41% (227/551) | 269-325 | ADDGYNWRKYGQKVV KGSDCPRSYYKCTHP NCPVKKKVEHAEDGQ ISEIIYKGKHNH | 1273 | 84% (48/57) |
| 1208 | Zm/GRMZ M2G076657_ T01 | 43% (225/522) | 227-283 | ADDGYNWRKYGQKVV KGSDCPRSYYKCTHP NCPVKKKVEHAEDGQ ISEIIYKGKHNH | 1279 | 84% (48/57) |
| 1210 | Zm/GRMZ M2G076657_ T02 | 45% (215/475) | 227-283 | ADDGYNWRKYGQKVV KGSDCPRSYYKCTHP NCPVKKKVEHAEDGQ ISEIIYKGKHNH | 1281 | 84% (48/57) |
| 1212 | Zm/GRMZ M2G143765_ T01 | 49% (195/402) | 229-285 | ADDGYNWRKYGQKVV KGSDCPRSYYKCTHP NCPVKKKVEHAEDGQ ISEIIYKGKHNH | 1283 | 84% (48/57) |
| 1216 | Si/Si021859m | 44% (230/521) | 228-284 | ADDGYNWRKYGQKVV KGSDCPRSYYKCTHP NCPVKKKVEHAEDGQ ISEIIYKGKHNH | 1287 | 84% (48/57) |
| 1224 | Bd/Bradi4g0 6690.1 | 43% (225/529) | 229-285 | ADDGYNWRKYGQKVV KGSDCPRSYYKCTHP SCPVKKKVEHAEDGQ ISEIIYKGKHNH | 1295 | 84% (48/57) |
| 1164 | Gm/Glyma0 7g35380.1 | 56% (209/373) | 74-130 | NDDGYNWRKYGQKHV KGRDFSRSYYKCTHP NCPVKKKLERSLEGH VTAIIYKGEHNH | 1235 | 83% (47/56) |
| 1186 | Pt/POPTR_0 004s12000.1 | 47% (258/550) | 208-264 | TDDGYNWRKYGQKPI KGSEYPRSYYKCTHL NCLVKKKVERSSDGQ ITEIIYKGQHNH | 1257 | 83% (47/56) |
| 1166 | Gm/Glyma2 0g03410.1 | 48% (248/518) | 173-229 | NNDGYNWRKYGQKHV KGSDFSRSYYKCTRP NCPVKKKLERSLEGH VTAIIYKGEHNH | 1237 | 82% (46/56) |
| 1200 | Os/LOC_Os 03g33012.1 | 46% (196/425) | 199-255 | ADDGYNWRKYGQKAV KGGEYPRSYYKCTHL SCPVKKKVERSSDGQ ITQILYRGQHNH | 1271 | 80% (46/57) |
| 1206 | Zm/GRMZ M2G171428_ T01 | 41% (223/540) | 211-267 | ADDGYNWRKYGQKAV KGGEYPRSYYKCTHT SCPVKKKVERSAEGH ITQIIYRGQHNH | 1277 | 78% (45/57) |
| 1214 | Si/Si035317m | 44% (223/508) | 217-273 | ADDGYNWRKYGQKAV KGGEYPRSYYKCTHA SCPVKKKVERSGEGH ITQIIYRGQHNH | 1285 | 78% (45/57) |
| 1178 | Sl/Solyc03g 104810.2.1 | 45% (219/484) | 213-269 | ASDGYNWRKYGQKMV KASECPRSYYKCTHL KCLVKKKVERSIDGH ITEITYKGHHNH | 1249 | 77% (44/57) |

TABLE 15-continued

Conserved first WRKY domain of
WRKY3 and closely related sequences

| Col. 1 SEQ ID NO: | Col. 2 Species/ Identifier | Col. 3 Percent identity of polypeptide in Col. 1 to WRKY3 | Col. 4 WRKY domain 1 in amino acid coordinates | Col. 5 Conserved WRKY domain 1 | Col. 6 SEQ ID NO: of WRKY domain 1 | Col. 7 Percent identity of first WRKY in Col. 5 to WRKY domain 1 of WRKY3 |
|---|---|---|---|---|---|---|
| 1222 | Bd/Bradi1g1 6120.1 | 43% (222/514) | 205-261 | ADDGYNWRKYGQKAV KGGEYPRSYYKCTQA GCPVKKKVERSACGE ITQIIYRGQHNH | 1293 | 77% (44/57) |
| 1184 | Eg/Eucgr. I01998.1 | 43% (226/527) | 295-351 | TEDGYNWRKYGQKQV KGCGFPRSYYKCSHL NCSVKKKVEHSLDGR ITEITYRGQHQH | 1255 | 76% (43/56) |
| 1194 | Cc/clementine 0.9_006505m | 51% (265/524) | 275-331 | ADDGYNWRKYGQKPI KGNEYPRSYYKCTHV NCPVKKKVERSSSAQ ITQIIYKNEHNH | 1265 | 75% (43/57) |
| 1176 | Sl/Solyc02g 088340.2.1 | 44% (214/486) | 216-272 | ACDGYNWRKYGQKKV KASECPRSYYKCTYL KCLVKKKVERSVDGH ITEITYNGRHNH | 1247 | 73% (42/57) |
| 1218 | Bd/Bradi 1g07970.1 | 41% (120/294) | 190-246 | GKDGYNWRKYGQKQL KDAESPRSYYKCTRE ACPVKKIVERSFDGC IKEITYKGRHTH | 1289 | 72% (40/55) |
| 1204 | Zm/GRMZ M2G008029_ T01 | 48% (112/232) | 219-275 | AKDGYTWRKYGQKQL KDAESPRSYYKCTRD GCPVKKVVERSFDGL IKEITYKGRHNH | 1275 | 70% (40/57) |
| 1220 | Bd/Bradi1g 2680.1 | 241% (156/377) | 176-231 | ADDGYNWRKYGQKAV KGGRYPRSYYKCTLN CPVRKNVEHSEDGKI IKIIYRGQHSH | 1291 | 70% (40/57) |
| 1198 | Os/LOC_Os 07g40570.1 | 42% (149/353) | 169-225 | TDDGYNWRKYGQKAV KGGEYPKSYYKCTHL NCLVRKNVEHSADGR IVQIIYRGQHTH | 1269 | 67% (38/56) |
| 1226 | Ta/ACD803 62.1 (WRKY19) | 44% (121/275) | 198-253 | ADDGYNWRKYGQKAV KGGKYPRSYYKCTLN CPARKNVEHSADRRI IKIIYRGQHCH | 1297 | 66% (38/57) |

TABLE 16

Conserved second WRKY Domain of
WRKY3 and closely related sequences

| Col. 1 SEQ ID NO: | Col. 2 Species/ Identifier | Col. 3 Percent identity of polypeptide in Col. 1 to WRKY3 | Col. 4 WRKY domain 2 in amino acid coordinates | Col. 5 Conserved WRKY domain 2 | Col. 6 SEQ ID NO: of second WRKY domain | Col. 7 Percent identity of second WRKY domain in Col. 5 to WRKY domain 2 of WRKY3 |
|---|---|---|---|---|---|---|
| 1156 | At/WRKY3 or AT2G03340.1 | 100% (513/513) | 414-471 | LDDGYRWRKYGQK VVKGNPYPRSYYK CTTPDCGVRKHVE RAATDPKAVVTTY EGKHNH | 1228 | 100% (58/58) |

TABLE 16-continued

Conserved second WRKY Domain of
WRKY3 and closely related sequences

| Col. 1 SEQ ID NO: | Col. 2 Species/ Identifier | Col. 3 Percent identity of polypeptide in Col. 1 to WRKY3 | Col. 4 WRKY domain 2 in amino acid coordinates | Col. 5 Conserved WRKY domain 2 | Col. 6 SEQ ID NO: of second WRKY domain | Col. 7 Percent identity of second WRKY domain in Col. 5 to WRKY domain 2 of WRKY3 |
|---|---|---|---|---|---|---|
| 1158 | At/AT1G1396 0.1 | 68% (370/541) | 408-465 | LDDGYRWRKYGQK VVKGNPYPRSYYK CTTPGCGVRKHVE RAATDPKAVVTTY EGKHNH | 1230 | 98% (57/58) |
| 1172 | Vv/GSVIVT 01001332001 | 59% (277/467) | 358-416 | LLDDGYRWRKYGQ KVVKGNPYPRSYY KCTNPGCNVRKHV ERAATDPKAVITT YEGKHNH | 1244 | 93% (55/59) |
| 1180 | Eg/Eucgr.B0 3189.1 | 53% (291/544) | 418-475 | LDDGYRWRKYGQK VVKGNPYPRSYYK CTTPGCNVRKHVE RASTDPKAVITTY EGKHNH | 1252 | 93% (54/58) |
| 1160 | Gm/Glyma0 1g06550.1 | 51% (265/519) | 342-399 | LDDGYRWRKYGQK VVKGNPYPRSYYK CTTQGCNVRKHVE RASTDPKAVITTY EGKHNH | 1232 | 91% (53/58) |
| 1162 | Gm/Glyma0 2g12490.1 | 51% (268/521) | 342-399 | LDDGYRWRKYGQK VVKGNPYPRSYYK CTTQGCNVRKHVE RASTDPKAVITTY EGKHNH | 1234 | 91% (53/58) |
| 1192 | Pt/POPTR_0 010s17040.1 | 57% (302/532) | 393-450 | LDDGYRWRKYGQK VVKGNPYPRSYYK CTTAGCKVRKHVE RAAADPKAVITTY EGKHNH | 1264 | 91% (53/58) |
| 1194 | Cc/clementine 0.9_006505m | 51% (265/524) | 444-501 | LDDGYRWRKYGQK VVKGNPHPRSYYK CTNPGCNVRKHVE RAPTDPKAVVTTY EGKHNH | 1266 | 91% (53/58) |
| 1196 | Cc/clementine 0.9_007348m | 61% (326/538) | 420-477 | LDDGYRWRKYGQK VVKGNPYPRSYYK CTTTGCNVRKHVE RASTDPKAVITTY EGKHNH | 1268 | 91% (53/58) |
| 1166 | Gm/Glyma2 0g03410.1 | 48% (248/518) | 324-381 | LDDGYRWRKYGQK VVKGNPYPRSYYK CTTQGCKVRKHVE RASMDPKAVITTY EGKHNH | 1238 | 89% (52/58) |
| 1174 | Sl/Solyc05g0 12770.2.1 | 53% (291/552) | 394-451 | LDDGYRWRKYGQK VVKGNPYPRSYYK CTSQGCNVRKHVE RAASDPKAVITTY EGKHNH | 1246 | 89% (52/58) |
| 1188 | Pt/POPTR_0 017s12430.1 | 50% (281/561) | 421-478 | LDDGYRWRKYGQK VVKGNPHPRSYYK CTSAGCNVRKHVE RAAADPKAVVTTY EGKHNH | 1260 | 89% (52/58) |

TABLE 16-continued

Conserved second WRKY Domain of
WRKY3 and closely related sequences

| Col. 1 SEQ ID NO: | Col. 2 Species/ Identifier | Col. 3 Percent identity of polypeptide in Col. 1 to WRKY3 | Col. 4 WRKY domain 2 in amino acid coordinates | Col. 5 Conserved WRKY domain 2 | Col. 6 SEQ ID NO: of second WRKY domain | Col. 7 Percent identity of second WRKY domain in Col. 5 to WRKY domain 2 of WRKY3 |
|---|---|---|---|---|---|---|
| 1190 | Pt/POPTR_0 008s09140.1 | 55% (297/540) | 390-447 | LDDGYRWRKYGQK VVKGNPYPRSYYK CTTPGCKVRKHVE RAAADPRAVITAY EGKHNH | 1262 | 89% (52/58) |
| 1164 | Gm/Glyma0 7g35380.1 | 56% (209/373) | 225-282 | LDDGYRWRKYGQK VVKGNPYPRSYYK CATQGCNVRKHVE RASMDPKAVLTTY EGKHNH | 1236 | 87% (51/58) |
| 1170 | Gm/Glyma1 8g49830.1 | 53% (281/529) | 406-463 | LDDGYRWRKYGQK VVKGNPHPRSYYK CTSAGCNVRKHVE RASTDPKAVITTY EGKHNH | 1242 | 87% (51/58) |
| 1182 | Eg/Eucgr.G0 2469.1 | 52% (255/495) | 411-468 | LDDGYRWRKYGQK LVKGNPYPRSYYK CTTTGCNVRKHVE RASSDPKAVITTY EGKHNH | 1254 | 87% (51/58) |
| 1186 | Pt/POPTR_0 004s12000.1 | 47% (258/550) | 368-425 | LDDGYRWRKYGQK VVKGNPHPRSYYK CTSAGCNVRKHVE RAAADPKAVITTY EGKHNH | 1258 | 87% (51/58) |
| 1168 | Gm/Glyma0 8g26230.1 | 52% (278/533) | 409-466 | LDDGYRWRKYGQK VVKGNPHPRSYYK CTSAGCNVRKHVE RASMDPKAVITTY EGKHNH | 1240 | 86% (50/58) |
| 1202 | Os/LOC_Os 12g32250.1 | 41% (227/551) | 426-483 | LDDGYRWRKYGQK VVKGNPHPRSYYK CTYAGCNVRKHIE RASSDPKAVITTY EGKHNH | 1274 | 84% (49/58) |
| 1216 | Si/Si021859m | 44% (230/521) | 385-442 | LDDGYRWRKYGQK VVKGNPHPRSYYK CTFAGCNVRKHIE RASSDPKAVITTY EGKHNH | 1288 | 84% (49/58) |
| 1224 | Bd/Bradi4g0 6690.1 | 43% (225/529) | 386-443 | LDDGYRWRKYGQK VVKGNPHPRSYYK CTFAGCNVRKHIE RASSDPKAVITTY EGKHNH | 1296 | 84% (49/58) |
| 1212 | Zm/GRMZM 2G143765_ T01 | 49% (195/402) | 386-443 | LDDGYRWRKYGQK VVKGNPHPRSYYK CTFAGCNVRKHIE RCSSDPKAVITTY EGKHNH | 1284 | 82% (48/58) |
| 1176 | Sl/Solyc02g0 88340.2.1 | 44% (214/486) | 386-443 | LDDGYKWRKYGQK VVKGTQHPRSYYR CTYPGCNVRKQVE RASTDPKAVITTY EGKHNH | 1248 | 81% (47/58) |

TABLE 16-continued

Conserved second WRKY Domain of
WRKY3 and closely related sequences

| Col. 1 SEQ ID NO: | Col. 2 Species/ Identifier | Col. 3 Percent identity of polypeptide in Col. 1 to WRKY3 | Col. 4 WRKY domain 2 in amino acid coordinates | Col. 5 Conserved WRKY domain 2 | Col. 6 SEQ ID NO: of second WRKY domain | Col. 7 Percent identity of second WRKY domain in Col. 5 to WRKY domain 2 of WRKY3 |
|---|---|---|---|---|---|---|
| 1178 | Sl/Solyc03g1 04810.2.1 | 45% (219/484) | 384-441 | LDDGFKWRKYGQK MVKGNHHPRSYYR CTYPGCNVRKHVE RASADPKAVITTY EGKHNH | 1250 | 79% (46/58) |
| 1184 | Eg/Eucgr.I01 998.1 | 43% (226/527) | 473-530 | LDDGFKWRKYGQK VVKGSSYPRSYYK CTYAGCNVRKHIE RAALDPKSVITTY EGKHNH | 1256 | 79% (46/58) |
| 1200 | Os/LOC_Os 03g33012.1 | 46% (196/425) | 366-423 | LDDGYRWRKYGQK VVKGNPHPRSYYK CTYQGCDVKKHIE RSSQDPKAVITTY EGKHSH | 1272 | 79% (46/58) |
| 1206 | Zm/GRMZM 2G171428_ T01 | 41% (223/540) | 380-437 | LDDGYRWRKYGQK VVKGNPYPRSYYR CTYQGCDVKKHIE RSSQDPKAVITTY EGKHSH | 1278 | 79% (46/58) |
| 1208 | Zm/GRMZM 2G076657_ T01 | 43% (225/522) | 384-441 | LDDGYRWRKYGQK VVKGNSHPRSYYK CTFAGCNVRKHIE RASSDPRAVITTY EGKHDH | 1280 | 79% (46/58) |
| 1210 | Zm/GRMZM 2G076657_ T02 | 45% (215/475) | 384-441 | LDDGYRWRKYGQK VVKGNSHPRSYYK CTFAGCNVRKHIE RASSDPRAVITTY EGKHDH | 1282 | 79% (46/58) |
| 1214 | Si/Si035317m | 44% (223/508) | 386-443 | LDDGYRWRKYGQK VVKGNPHPRSYYK CTYQGCDVKKHIE RSSQDPKAVITTY EGKHSH | 1286 | 79% (46/58) |
| 1198 | Os/LOC_Os 07g40570.1 | 42% (149/353) | 338-395 | LDDGYRWRKYGQK VVKGNPYPRSYYK CTYLGCDVKKQVE RSVEEPNAVITTY EGKHIH | 1270 | 77% (45/58) |
| 1204 | Zm/GRMZM 2G008029_ T01 | 48% (112/232) | 349-406 | LDDGYRWRKYGQK VVKGNPRPRSYYK CTADNCNVRKQIE RATTDPRCVLTTY TGRHNH | 1276 | 77% (45/58) |
| 1220 | Bd/Bradi1g2 2680.1 | 41% (156/377) | 341-398 | LDDGYRWRKYGQK VVRGNPHPRSYYK CTYQGCDVKKHIE RSSQEPHAVITTY EGKHVH | 1292 | 74% (43/58) |
| 1222 | Bd/Bradi1g1 6120.1 | 43% (222/514) | 374-431 | LDDGYRWRKYGQK VVKGNPHPRSYYK CTFQGCDVKKHIE RCSQDSTDVITTY EGKHSH | 1294 | 74% (43/58) |

TABLE 16-continued

Conserved second WRKY Domain of WRKY3 and closely related sequences

| Col. 1 SEQ ID NO: | Col. 2 Species/ Identifier | Col. 3 Percent identity of polypeptide in Col. 1 to WRKY3 | Col. 4 WRKY domain 2 in amino acid coordinates | Col. 5 Conserved WRKY domain 2 | Col. 6 SEQ ID NO: of second WRKY domain | Col. 7 Percent identity of second WRKY domain in Col. 5 to WRKY domain 2 of WRKY3 |
|---|---|---|---|---|---|---|
| 1226 | Ta/ACD8036 2.1 (WRKY19) | 44% (121/275) | 362-419 | LDDGYRWRKYGQK VVRGNPHPRSYYK CTYQGCDVKKHIE RSSEEPHAVITTY EGKHTH | 1298 | 74% (43/58) |
| 1218 | Bd/Bradi1g0 7970.1 | 41% (120/294) | 323-380 | LDDGYRWRKYGQK VVKGNPRPRSYYK CTAENCNVRKQIE RASSNPSCVLTTY TGRHSH | 1290 | 72% (42/58) |

Species abbreviations for Tables 15 and 16:
At—*Arabidopsis thaliana*;
Bd—*Brachypodium distachyon*;
Cc—*Citrus clementina*;
Eg—*Eucalyptus grandis*;
Gm—*Glycine max*;
Os—*Oryza sativa*;
Pt—*Populus trichocarpa*;
Si—*Setaria italica*;
Sl—*Solanum lycopersicum*;
Ta—*Triticum aestivum*;
Vv—*Vitis vinifera*;
Zm—*Zea mays*

Sequences that are functionally-related and/or closely-related to the polypeptides in Tables 15 and 16 may be created artificially, semi-synthetically, or may occur naturally by having descended from the same ancestral sequence as the disclosed WRKY3-related sequences, where the polypeptides have the function of conferring increased photosynthetic resource use efficiency to plants.

Figure 24K:
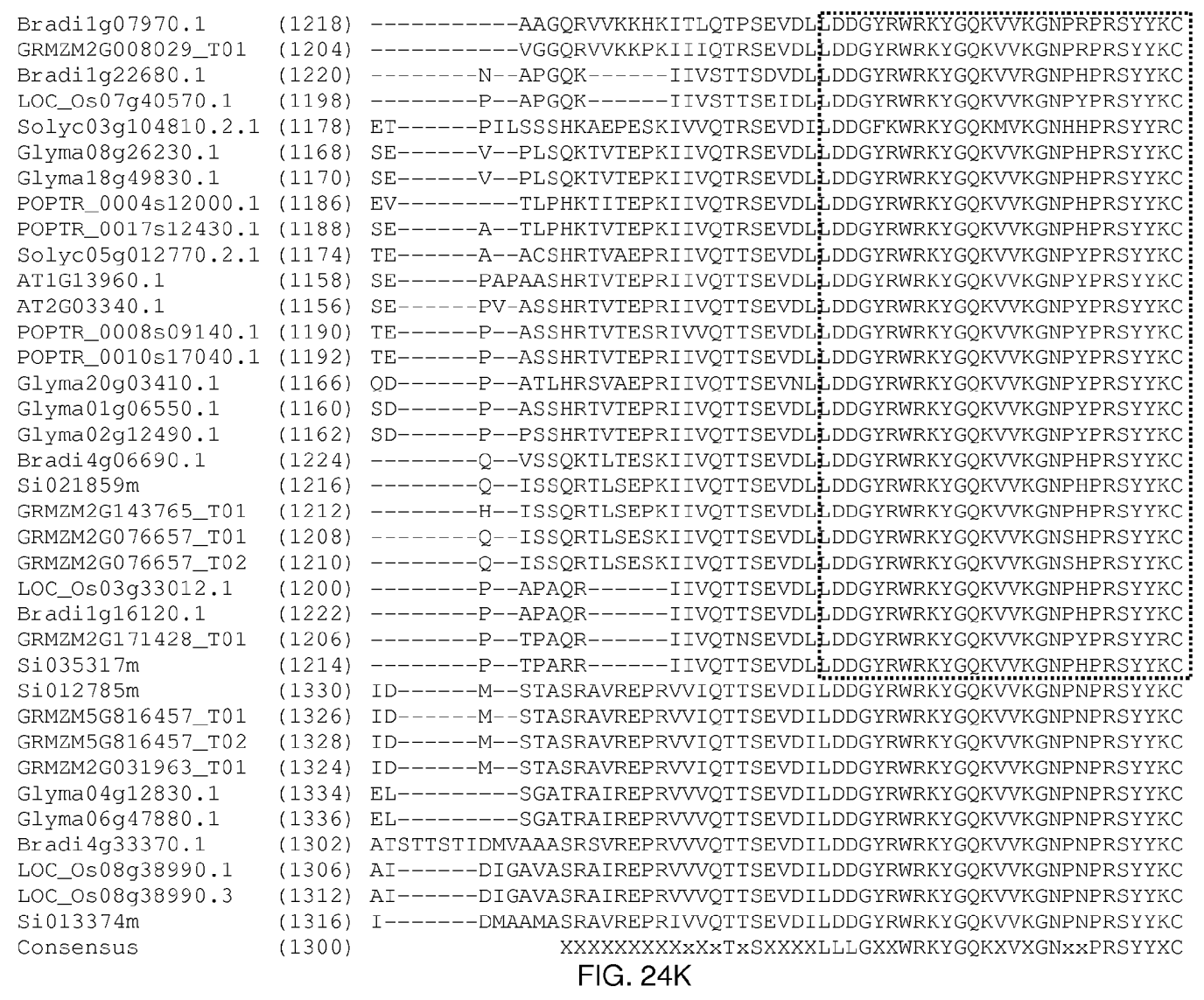

As shown in FIG. 24G-24H, these "functionally-related and/or closely-related" WRKY3 clade polypeptides generally contain a consensus sequence of the WRKY3 clade (SEQ ID NO: 1299), which contains the first WRKY domain found in WRKY3 clade members:

$X^1X^2PxxDGYxWX^3KYGQKxX^4KxX^5xxxX^3SYX^6KCTxxxCxVX^3K$ $xX^4EX^7X^8xxGxX^4xxIxYX^3GxHxH.*$ As shown in FIG. 24K-24L, these "functionally-related and/or closely-related" WRKY3 clade polypeptides also generally contain a consensus sequence of the WRKY3 clade (SEQ ID NO: 1300), which contains the second WRKY domain found in WRKY3 clade members:

$X^9X^3X^{10}X^{10}X^{10}X^{10}X^{10}X^{10}X^4xX^4xTxSX^{11}X^4X^{12}X^4LLLGX^6X^3WRKY$ $GQKX^4VX^3GNxxPRSYYX^3CTxxxCxVX^3KX^{13}X^4ERX^8xxX^1X^{14}xx$ $VX^4TX^{15}YxGX^3HxHxxX^{10}PxxX^3.*$

*In the above consensus sequences of SEQ ID NO: 1299-1300, x represents any amino acid; $X^1$ is D, N, or E; $X^2$ is K, R, or Q; $X^3$ is R or K; $X^4$ is I, L, V, or M; $X^5$ is G, S, or A; $X^6$ is Y or F; $X^7$ is R or H; $X^8$ is S, A, or C; $X^9$ is Q, H or R; $X^{10}$ is any amino acid or absent; $X^{11}$ is E or D; $X^{12}$ is D or N; $X^{13}$ is H or Q; $X^{14}$ is P or S; and $X^{15}$ is T or A. Alternative consensus sequences comprising the above with conservative substitutions found in Table 1 are also envisaged and may be expected to provide equivalent function(s).

The presence of one or more of these consensus sequences and/or these amino acid residues is correlated with conferring of improved or increased photosynthetic resource use efficiency to a plant when the expression level of the polypeptide is altered in a plant by being reduced, knocked-out, or overexpressed. A WRKY3 clade polypeptide sequence that is "functionally-related and/or closely-related" to the listed full length protein sequences or domains provided in Tables 15 or 16 may also have at least 41%, 42%, 43%, 44%, 45%, 46%, 47%, 48%, 49%, 50%, 51%, 52%, 53%, 55%, 56%, 57%, 59%, 61%, 68%, or about 100% amino acid identity to SEQ ID NO: 1156, and/or at least 66%, 67%, 70%, 72%, 73%, 75%, 76%, 77%, 78%, 80%, 82%, 83%, 84%, 85%, 87%, 91%, 92%, 94%, 96%, or about 100% amino acid identity to the first WRKY domain of SEQ ID NO: 1156, and/or at least 72%, 74, 77%, 79%, 81%, 82%, 84%, 86%, 87%, 89%, 91%, 93%, 98%, or about 100% amino acid identity to the second WRKY domain of SEQ ID NO: 1156 in its amino acid sequence to the entire length of a listed sequence or to a listed first WRKY domains, or to a listed second WRKY domains, or to the amino acid sequence of SEQ ID NO: 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, or 1226, or 1227-1298. The presence of the disclosed conserved first WRKY domains and/or second WRKY domains in the polypeptide sequence (for example, SEQ ID NO: 1227-1298), is correlated with the conferring of improved or increased photosynthetic resource use efficiency to a plant when the expression level of the polypeptide is altered in a plant by being reduced, knocked-out, or overexpressed. All of the sequences that adhere to these functional and sequential relationships are herein referred to as "WRKY3 clade polypeptides" or "WRKY3 clade polypeptides", or which fall within the "WRKY3 clade" or "G878 clade" exemplified in the phylogenetic tree in FIG. 23 as those polypeptides bounded by Bradi1g07970.1 and Solyc03g104810.2.1.

TABLE 17

Conserved NAM domain of AtNAC6 and closely related sequences

| Col. 1 SEQ ID NO: | Col. 2 Species/ Identifier | Col. 3 Percent identity of polypeptide in Col. 1 to AtNAC6 | Col. 4 NAM domain in amino acid coordinates | Col. 5 Conserved NAM domain | Col. 6 SEQ ID NO: of the NAM domain | Col. 7 Percent identity of NAM in Col. 5 to NAM domain of AtNAC6 |
|---|---|---|---|---|---|---|
| 1369 | At/AtNAC6 or AT5G39610 | 100% (285/285) | 20-145 | LPPGFRFHPTDEELI THYLKPKVFNTENSA TAIGEVDLNKIEPWD LPWKAKMGEKEWYNN CVRDRKYPTGLRTNR ATEAGYWKATGKDKE IFKGKSLVGMKKTLV FYKGRAPKGVKTNWV MHEYRL | 1434 | 100% (126/126) |
| 1373 | At/AT3G29035.1 | 62% (206/329) | 24-149 | LPPGFRFHPTDEELI THYLRPKVVNSNNSA IAIGEVDLNKVEPWD LPWKAKLGEKEWYFF CVRDRKYPTGLRTNR ATKAGYWKATGKDKE IFKGKSLVGMKKTLV FYKGRAPKGVKTNWV MHEYRL | 1436 | 94% (119/126) |
| 1411 | Cc/clementine 0.9_014567m | 51% (181/349) | 12-137 | LPPGFRFHPTDEELI THYLTPKVFDGCFSA RAIGEVDLNKCEPWD LPRRAKMGEKEWYFF CVRDRKYPTGLRTNR ATEAGYWKATGKDKE IYKAKALVGMKKTLV FYKGRAPKGQKTNWV MHEYRL | 1455 | 90% (114/126) |
| 1375 | At/AT5G61430.1 | 71% (156/217) | 16-141 | LPPGFRFHPTDEELI THYLHKKVLDTSFSA KAIGEVDLNKSEPWE LPWMAKMGEKEWYNN CVRDRKYPTGLRTNR ATEAGYWKATGKDKE IYRGKSLVGMKKTLV FYRGRAPKGQKTNWV MHEYRL | 1437 | 89% (113/126) |
| 1379 | Gm/Glyma06g2 1020.1 | 68% (149/217) | 18-143 | LPPGFRFHPTDEELI SHYLYRKVTDTNFSA RAIGEVDLNRSEPWD LPWKAKMGEKEWYFF CVRDRKYPTGLRTNR ATESGYWKATGKDKE IFRGKSLVGMKKTLV FYKGRAPKGEKTDWV MHEYRL | 1439 | 89% (113/126) |
| 1381 | Gm/Glyma17g1 0970.1 | 69% (149/214) | 16-141 | LPPGFRFHPTDEELI SHYLYKKVIDTKFCA RAIGEVDLNKSEPWD LPWKAKMGEKEWYFF CVRDRKYPTGLRTNR ATEAGYWKATGKDKE IFRGKSLVGMKKTLV FYRGRAPKGEKSNWV MHEYRL | 1440 | 89% (113/126) |

TABLE 17-continued

Conserved NAM domain of AtNAC6 and closely related sequences

| Col. 1 SEQ ID NO: | Col. 2 Species/ Identifier | Col. 3 Percent identity of polypeptide in Col. 1 to AtNAC6 | Col. 4 NAM domain in amino acid coordinates | Col. 5 Conserved NAM domain | Col. 6 SEQ ID NO: of the NAM domain | Col. 7 Percent identity of NAM in Col. 5 to NAM domain of AtNAC6 |
|---|---|---|---|---|---|---|
| 1405 | Vv/GSVIVT010 11445001 | 56% (166/293) | 16-141 | LPPGFRFHPTDEELI THYLSQKVLNSGFCA VAIGEVDLNKCEPWD LPWKAKMGEKEWYFF CVRDRKYPTGLRTNR ATDAGYWKATGKDKE IYKMKTLVGMKKTLV FYKGRAPKGEKTNWV MHEYRL | 1452 | 89% (113/126) |
| 1417 | Eg/Eucgr. B00529.1 | 64% (155/242) | 16-141 | LPPGFRFHPTDEELI THYLQKKVGDTGFSA KAIGEVDLNKSEPWD LPWKAKMGEKEWYFF CLRDRKYPTGLRTNR ATESGYWKATGKDKE IYRGKSLVGMKKTLV FYRGRAPKGEKTNWV MHEYRL | 1458 | 89% (113/126) |
| 1371 | At/AT5G07680.1 | 67% (159/236) | 17-142 | LPPGFRFHPTDEELI THYLHKKVLDLGFSA KAIGEVDLNKAEPWE LPYKAKIGEKEWYFF CVRDRKYPTGLRTNR ATQAGYWKATGKDKE IFRGKSLVGMKKTLV FYRGRAPKGQKTNWV MHEYRL | 1435 | 88% (111/126) |
| 1377 | Gm/Glyma04g3 3270.1 | 69% (147/211) | 3-128 | LPPGFRFHPTDEELI SHYLYRKVTHTNFSA RAIGEVDLNRSEPWD LPWKAKMGEKEWYFF CVRDRKYPTGLRTNR ATQSGYWKATGKDKE IFRGKSLVGMKKTLV FYKGRAPKGEKTDWV MHEYRL | 1438 | 88% (112/126) |
| 1393 | Sl/Solyc02g0 88180.2.1 | 56% (174/310) | 16-141 | LPPGFRFHPTDEELI THYLAPKVLDSGFCA IAIGEVDLNKVEPWD LPWKAKMGEKEWYFF CMRDKKYPTGQRTNR ATEAGYWKATGKDKE IFKSKTLVGMKKTLV FYKGRAPRGEKTNWV MHEYRL | 1446 | 88% (111/126) |
| 1399 | Pt/POPTR_0012 s01610.1 | 66% (156/234) | 17-142 | LPPGFRFHPTDEELI SHYLYKKVLDINFSA RAIGDVDLNKSEPWE LPWKAKMGEKEWYFL CVRDRKYPTGLRTNR ATEAGYWKATGKDKE IYRGKSLVGMKKTLV FYKGRAPKGEKTNWV MHEYRL | 1449 | 88% (112/126) |
| 1401 | Pt/POPTR_0015 s02170.1 | 61% (161/262) | 17-142 | LPPGFRFHPTDEELI SHYLYKKVLDITFSA KAIGDVDLNKSEPWE LPWKAKMGEKEWYFF CVRDRKYPTGLRTNR ATEAGYWKATGKDKE | 1450 | 88% (111/126) |

TABLE 17-continued

Conserved NAM domain of AtNAC6 and closely related sequences

| Col. 1 SEQ ID NO: | Col. 2 Species/ Identifier | Col. 3 Percent identity of polypeptide in Col. 1 to AtNAC6 | Col. 4 NAM domain in amino acid coordinates | Col. 5 Conserved NAM domain | Col. 6 SEQ ID NO: of the NAM domain | Col. 7 Percent identity of NAM in Col. 5 to NAM domain of AtNAC6 |
|---|---|---|---|---|---|---|
| | | | | IYRGKFLVGMKKTLV FYKGRAPKGGKTNWV MHEYRL | | |
| 1391 | Gm/Glyma05g0 0930.1 | 68% (148/217) | 16-139 | LPPGFRFHPTDEELI SHYLYKKVIDTKFCA RAIGEVDLNKSEPWD LPSKMGEKEWYFFCV RDRKYPTGLRTNRAT EAGYWKATGKDKEIF RGKSLVGMKKTLVFY RGRAPKGEKSNWVMH EYRL | 1445 | 87% (110/126) |
| 1397 | Sl/Solyc06g0697 10.2.1 | 70% (149/211) | 16-141 | LPPGFRFHPTDEELI THYLSNKVVDTNFVA IAIGDVDLNKVEPWD LPWKAKMGEKEWYFF CVRDKKYPTGLRTNR ATAAGYWKATGKDRE IFRGKSLVGMKKTLV FYKGRAPKGEKTNWV IHEFRL | 1448 | 87% (110/126) |
| 1407 | Vv/GSVIVT010 07982001 | 72% (150/207) | 3-128 | LPPGFRFHPTDEELI THYLSKKVIDSNFSA RAIGQVNLNNSEPWE LPGKAKMGEKEWYFF CVRDRKYPTGLRTNR ATEAGYWKATGKDKE IFRGKSLVGMKKTLV FYAGRAPKGEKTNWV MHEYRL | 1453 | 87% (110/126) |
| 1403 | Pt/POPTR_0017 s12210.1 | 59% (148/250) | 16-141 | LPPGFRFHPTDEELI THYLSQKVLDNYFCA RAIGEVDLNKCEPWD LPWRAKMGEKEWYFF CVIDRKYPTGLRTNR ATDAGYWKATGKDKE IYRAKTLVGMKKTLV FYKGRAPKGEKTNWV MHEYRL | 1451 | 86% (109/126) |
| 1395 | Sl/Solyc03g1158 50.2.1 | 63% (145/228) | 18-143 | LPPGFRFHPTDEELI THYLSKKVVDMNFSA IAIGDVDMNKIEPWE LPWKAKIGEKEWYFF CVRDKKYPTGLRTNR ATAAGYWKATGKDKE IFRGRSLVGMKKTLV FYRGRAPRGEKTNWV THEYRL | 1447 | 84% (107/126) |
| 1409 | Cc/clementine 0.9_013688m | 66% (142/215) | 16-141 | LPPGFRFHPTDEELI THYLYKKVLDVCFSC RAIGDVDLNKNEPWE LPWKAKMGEKEWYFF CMRDRKYPTGLRTNR ATVSGYWKATGKDKE IYRGKSLVGMKKTLV FYRGRAPKGEKSSWV MHEYRL | 1454 | 84% (106/126) |
| 1413 | Cc/clementine 0.9_012151m | 57% (142/248) | 16-141 | LPPGFRFHPTDEELI THYLYKKVLDVCFSC RAIGDVDLNKNEPWE LPWKAKMGEKEWYFF | 1456 | 84% (106/126) |

TABLE 17-continued

Conserved NAM domain of AtNAC6 and closely related sequences

| Col. 1 SEQ ID NO: | Col. 2 Species/ Identifier | Col. 3 Percent identity of polypeptide in Col. 1 to AtNAC6 | Col. 4 NAM domain in amino acid coordinates | Col. 5 Conserved NAM domain | Col. 6 SEQ ID NO: of the NAM domain | Col. 7 Percent identity of NAM in Col. 5 to NAM domain of AtNAC6 |
|---|---|---|---|---|---|---|
| | | | | CMRDRKYPTGLRTNR ATVSGYWKATGKDKE IYRGKSLVGMKKTLV FYRGRAPKGEKSSWV MHEYRL | | |
| 1415 | Eg/Eucgr. I01958.1 | 72% (121/167) | 16-141 | LPPGFRFHPTDEELI THYLTPKVLDGSFRA RAMGEVDLNKCEPWD LPGQAKMGEKEWYFF CVRDRKYPTGMRTNR ATEAGYWKATGKDKE IRRMKKVVGMKKTLV FYRGRAPNGQKTNWV MHEFRL | 1457 | 83% (105/126) |
| 1383 | Gm/Glyma13g0 5540.1 | 63% (138/217) | 20-145 | LPPGFRFHPTDEELI THYLSQKVLDSCFCA RAIGEADLNKCEPWD LPWMAKMGEKEWYFF CVRDRKYPTGQRTNR ATGVGYWKATGKDRE IYKAKALIGMKKTLV FYKGRAPSGEKTSWV MHEYRL | 1441 | 82% (104/126) |
| 1385 | Gm/Glyma19g0 2850.1 | 62% (141/225) | 8-133 | LPPGFRFHPTDEELI THYLSQKVLDSCFCA RAIGEADLNKCEPWD LPCMAKMGEKEWYFF CVRDRKYPTGQRTNR ATGAGYWKATGKDRE IYKAKTLIGMKKTLV FYKGRAPSGEKSNWV MHEYRL | 1442 | 82% (104/126) |
| 1387 | Gm/Glyma09g3 7050.1 | 60% (139/229) | 19-144 | LPAGFRFHPRDEELI NHYLTKKVVDNCFCA VAIAEVDLNKCEPWD LPGLAKMGETEWYFF CVRDRKYPTGLRTNR ATDAGYWKATGKDRE IIMENALIGMKKTLV FYKGRAPKGEKTNWV MHEYRL | 1443 | 80% (101/126) |
| 1431 | Os/LOC_Os04g 38720.1 | 56% (133/236) | 12-137 | LPPGFRFHPTDEELI THYLAKKVADARFAA LAVAEADLNKCEPWD LPSLAKMGEKEWYFF CLKDRKYPTGLRTNR ATESGYWKATGKDKD IFRRKALVGMKKTLV FYTGRAPKGEKSGWV MHEYRL | 1465 | 80% (101/126) |
| 1433 | Si/Si010553m | 61% (134/217) | 11-136 | LPPGFRFHPTDEELI THYLARKVADARFAA FAVSEADLNKCEPWD LPSLAKMGEKEWYFF CLKDRKYPTGLRTNR ATEAGYWKATGKDKD IFRGKALVGSKKTLV FYTGRAPKGEKSGWV MHEYRL | 1466 | 80% (102/126) |

TABLE 17-continued

Conserved NAM domain of AtNAC6 and closely related sequences

| Col. 1 SEQ ID NO: | Col. 2 Species/ Identifier | Col. 3 Percent identity of polypeptide in Col. 1 to AtNAC6 | Col. 4 NAM domain in amino acid coordinates | Col. 5 Conserved NAM domain | Col. 6 SEQ ID NO: of the NAM domain | Col. 7 Percent identity of NAM in Col. 5 to NAM domain of AtNAC6 |
|---|---|---|---|---|---|---|
| 1389 | Gm/Glyma18g49620.1 | 62% (142/228) | 19-144 | LPAGFRFHPTDEELINQYLTKKVVDNCFCAIAIGEVDLNKCEPWDLPGLAKMGETEWYFFCVRDRKFPTGIRTNRATDIGYWKATGKDKEIIMENALIGMKKTLVFYKGRAPKGEKTNWVMHEYRL | 1444 | 79% (100/126) |
| 1421 | Bd/Bradi5g12407.1 | 59% (133/222) | 3-129 | LPPGFRFHPTDEELITHYLAKKVADARFTAFAVSEADLNKCEPWDLPSLARMGEKEWYFFCLKDRKYPTGLRTNRATESGYWKATGKDKDIFRGKGTLVGMKKTLVFYTGRAPKGEKSGWVMHEYRL | 1460 | 79% (101/127) |
| 1423 | Os/LOC_Os02g36880.1 | 54% (137/250) | 37-163 | LPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRI | 1461 | 79% (101/127) |
| 1425 | Os/LOC_Os02g36880.3 | 54% (137/250) | 37-163 | LPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRI | 1462 | 79% (101/127) |
| 1427 | Os/LOC_Os02g36880.2 | 54% (137/250) | 37-163 | LPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRI | 1463 | 79% (101/127) |
| 1429 | Os/LOC_Os02g36880.4 | 54% (136/250) | 37-163 | LPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRI | 1464 | 79% (101/127) |
| 1419 | Bd/Bradi3g46900.1 | 57% (136/237) | 16-142 | LPPGFRFHPTDEELVTHYLARKTADPTGFAARAVGEADLNKCEPWDLPSRATMGEKEWYFFVVKDRKYPTGTRTN | 1459 | 78% (100/127) |

TABLE 17-continued

Conserved NAM domain of AtNAC6
and closely related sequences

| Col. 1 SEQ ID NO: | Col. 2 Species/ Identifier | Col. 3 Percent identity of polypeptide in Col. 1 to AtNAC6 | Col. 4 NAM domain in amino acid coordinates | Col. 5 Conserved NAM domain | Col. 6 SEQ ID NO: of the NAM domain | Col. 7 Percent identity of NAM in Col. 5 to NAM domain of AtNAC6 |
|---|---|---|---|---|---|---|
| | | | | RATESGYWKATGKDR EILRGKALVGMKKTL VFYTGRAPKGGKTGW VMHEYRL | | |

Species abbreviations for Table 17:
At—*Arabidops's thaliana*;
Bd—*Brachypodium distachyon*;
Cc—*Citrus x clementina*;
Eg—*Eucalyptus grandis*;
Gm—*Glycine max*;
Os—*Oryza sativa*;
Pt—*Populus trichocarpa*;
Si—*Setaria italica*;
Sl—*Solanum lycopersicum*;
Vv—*Vitis vinifera*

Sequences that are functionally-related and/or closely-related to the polypeptides in Table 17 may be created artificially, semi-synthetically, or may occur naturally by having descended from the same ancestral sequence as the disclosed AtNAC6-related sequences, where the polypeptides have the function of conferring increased photosynthetic resource use efficiency to plants.

As shown in FIG. 29A-29C, these "functionally-related and/or closely-related" AtNAC6 clade polypeptides generally contain a consensus sequence of the AtNAC6 clade, SEQ ID NO: 1467:

$LPX^1GFRFHPxDEEX^2X^2xX^3YLxxX^4xxxX^5xxFxxxAX^2X^6xxX^7X^2NKx$
$EPWX^8LPX^9X^9X^{10}xX^2GExX^8WX^{11}FFxX^2xDX^4XX^{11}PTGxRTNRATxxGY$
$WKATGKDX^4X^8IxxxxxX^2X^2GxKKTLVFYxGRAPxGxKX^{12}xWVxHEX^{11}$
$RX^2.\ *$ As shown in FIG. 29D, these "functionally-related and/or closely-related" AtNAC6 clade polypeptides also generally contain a small consensus sequence SEQ ID NO: 1468:

$X^8xxX^2X^{13}X^4X^2F.\ *$

There is also a small motif that is present in AtNAC6 clade member proteins, and is identifiable in FIG. 29E and as SEQ ID NO: 1469:

$X^2PxLxX^8xX^{10}.\ *$

*In the above consensus sequences of SEQ ID NO: 1467, 1468 or 1469, x represents any amino acid; $X^1$ is P or A; $X^2$ is I, V, L, or M; $X^3$ is H or Q; $X^4$ is K or R; $X^5$ is P or absent; $X^6$ is G, A, or S; $X^7$ is D or N; $X^8$ is D or E; $X^9$ is any amino acid or absent; $X^{10}$ is A or S; $X^{11}$ is Y or F; $X^{12}$ is T or S; and $X^{13}$ is C or S. Alternative consensus sequences comprising the above with conservative substitutions found in Table 1 are also envisaged and may be expected to provide equivalent function(s).

The presence of one or more of these consensus sequences and/or these amino acid residues is correlated with conferring of improved or increased photosynthetic resource use efficiency to a plant when the expression level of the polypeptide is altered in a plant by being reduced, knocked-out, or overexpressed. A AtNAC6 clade polypeptide sequence that is "functionally-related and/or closely-related" to the listed full length protein sequences or domains provided in Table 17 may also have at least at least 51%, at least 54%, at least 56%, at least 57%, at least 59%, at least 60%, at least 61%, at least 62%, at least 63%, at least 64%, at least 66%, at least 67%, at least 68%, at least 69%, at least 70%, at least 71%, at least 72%, or about 100% amino acid identity to SEQ ID NO: 1369, and/or at least at least 78%, at least 79%, at least 80%, at least 82%, at least 83%, at least 84%, at least 86%, at least 87%, at least 88%, at least 89%, at least 90%, at least 94%, or about 100% amino acid identity to the NAM domain of SEQ ID NO: 1369 in its amino acid sequence to the entire length of a listed sequence or to a listed NAM domain (for example, any of SEQ ID NOs: 1434-1466), or to the amino acid sequence of SEQ ID NO: 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, or 1433 and/or comprise SEQ ID NO: 1467, SEQ ID NO: 1468 and/or SEQ ID NO: 1469. The presence of the disclosed conserved NAM domains in the polypeptide sequence (for example, SEQ ID NO: 1434-1466), is correlated with the conferring of improved or increased photosynthetic resource use efficiency to a plant when the expression level of the polypeptide is altered in a plant by being reduced, knocked-out, or overexpressed. All of the sequences that adhere to these functional and sequential relationships are herein referred to as "AtNAC6 clade polypeptides" or "AtNAC6 clade polypeptides", or which fall within the "AtNAC6 clade" or G525 clade" exemplified in the phylogenetic tree in FIG. 28 as those polypeptides bounded by Bradi3g46900.1 and GSVIVT01007982001.

TABLE 18

Conserved Plant Zinc Cluster Domains' of WRKY17 and closely related sequences

| Col. 1 SEQ ID NO: | Col. 2 Species/ Identifier | Col. 3 Percent identity of polypeptide in Col. 1 to WRKY17 | Col. 4 Plant Zinc Cluster Domain in amino acid coordinates | Col. 5 Plant Zinc Cluster Domain | Col. 6 SEQ ID NO: of Plant Zinc Cluster Domain | Col. 7 Percent identity of Plant Zinc Cluster Domain in Col. 5 to Plant zinc cluster domain of WRKY17 |
|---|---|---|---|---|---|---|
| 1507 | At/WRKY17 or AT2G24570 | 100% (314/314) | 191-240 | RKRCLEHDHSEGFSGKISGSGNGKCHCKKSRKNRMKRTVRVPAVSAKIAD | 1532 | 100% |
| 1509 | At/AT4G31550.1 | 74% (244/328) | 194-243 | RKRCLEHEHSESFSGKVSGSAYGKCHCKKSRKNRMKRTVRVPAISAKIAD | 1533 | 86% |
| 1519 | Cc/clementine 0.9_014855m | 64% (223/345) | 209-261 | KKRCQDHKDHSDDLSGKFSGSTSGNNKCHCSKRRKNRVKKTIRVPAISSKIAD | 1538 | 70% |
| 1511 | Gm/Glyma14g17730.1 | 59% (202/337) | 191-235 | KKRCEHREHSGDVSGNSKCHCVKRRKNRVKNTVRVPAISSKIAD | 1534 | 70% |
| 1521 | Eg/Eucgr.C04011.1 | 62% (214/343) | 213-262 | KKRCHEHDPSDNISGKHSGSGSGKCHCSKRRKNRVKKVTRVPAISNKIAD | 1539 | 68% |
| 1523 | Eg/Eucgr.C04011.2 | 63% (210/332) | 213-262 | KKRCHEHDPSDNISGKHSGSGSGKCHCSKRRKNRVKKVTRVPAISNKIAD | 1540 | 68% |
| 1513 | Gm/Glyma17g29190.1 | 59% (201/338) | 191-235 | KKRCHEHREHSDDVSGNSKCHCVKRRKNRVKSTVRVPAISSKVAD | 1535 | 68% |
| 1515 | Gm/Glyma06g08120.1 | 61% (201/326) | 175-223 | KKRCHDHREHSDEISGKLSGSSKCHCTKRRKNRVKKTVRVPVISSKIAD | 1536 | 64% |
| 1531 | Zm/GRMZM2G091331_T01 | 49% (162/327) | 180-222 | RKPCAGAHSEATTNGSRCHCSKRRKNRVKRTIRVPAISAKIAD | 1544 | 62% |
| 1529 | Zm/GRMZM2G071907_T01 | 50% (159/316) | 167-209 | RKPCAGAHSEATTNGSRCHCSKRRKNRVKRTIRVPAISSKVAD | 1543 | 58% |
| 1517 | Sl/Solyc12g096350.1.1 | 47% (160/340) | 211-256 | RCREHEQSDAISGSKSTGSGKCHCKKRKAKDRKVIRIPAISTRVAD | 1537 | 50% |
| 1525 | Os/LOC_Os08g13840.1 | 46% (153/327) | 191-239 | HPPCAAAGDGHGHGAGHAHAHGGCHCSKKRKQRVRRTVRVAAASARVAD | 1541 | 43% |
| 1527 | Os/LOC_Os08g13840.2 | 46% (153/327) | 191-239 | HPPCAAAGDGHGHGAGHAHAHGGCHCSKKRKQRVRRTVRVAAASARVAD | 1542 | 43% |

TABLE 19

Conserved WRKY DNA-binding Domain of WRKY17 and closely related sequences

| Col. 1 SEQ ID NO: | Col. 2 Species/ Identifier | Col. 3 Percent identity of polypeptide in Col. 1 to WRKY17 | Col. 4 WRKY DNA-binding Domain in amino acid coordinates | Col. 5 WRKY DNA-binding Domain | Col. 6 SEQ ID NO: of WRKY DNA-binding Domain | Col. 7 Percent identity of WRKY DNA-binding Domain in Col. 5 to WRKY DNA-binding Domain of WRKY17 |
|---|---|---|---|---|---|---|
| 1507 | At/WRKY17 or AT2G24570.1 | 100% (314/314) | 242-300 | PPDEYSWRKYGQKPI KGSPHPRGYYKCSTF RGCPARKHVERALDD STMLIVTYEGEHRH | 1545 | 100% |
| 1509 | At/AT4G31550.1 | 74% (244/328) | 245-303 | PPDEYSWRKYGQKPI KGSPHPRGYYKCSTF RGCPARKHVERALDD PAMLIVTYEGEHRH | 1546 | 96% |
| 1519 | Cc/clementine 0.9_014855m | 64% (223/345) | 263-321 | PPDEYSWRKYGQKPI KGSPYPRGYYKCSTM RGCPARKHVERAPDD PTMLIVTYEGEHRH | 1551 | 93% |
| 1511 | Gm/Glyma14g1 7730.1 | 59% (202/337) | 237-295 | PPDEYSWRKYGQKPI KGSPYPRGYYKCSTV RGCPARKHVERAPDD PAMLIVTYEGEHRH | 1547 | 91% |
| 1513 | Gm/Glyma17g2 9190.1 | 59% (201/338) | 237-295 | PPDEYSWRKYGQKPI KGSPYPRGYYKCSTI RGCPARKHVERAPDD PAMLIVTYEGEHRH | 1548 | 91% |
| 1515 | Gm/Glyma06g0 8120.1 | 61% (201/326) | 225-283 | PPDEYSWRKYGQKPI KGSPYPRGYYKCSSV RGCPARKHVERAPDD PTMLIVTYEGEHRH | 1549 | 91% |
| 1531 | Zm/GRMZM2G 091331_T01 | 49% (162/327) | 224-282 | PPDEYSWRKYGQKPI KGSPYPRGYYKCSTV RGCPARKHVERATDD PAMLVVTYEGEHRH | 1557 | 89% |
| 1521 | Eg/Eucgr. 004011.1 | 62% (214/343) | 264-322 | PADEFSWRKYGQKPI KGSPFPRGYYKCSTM RGCPARKHVERAPDD PTMLIVTYEGEHRH | 1552 | 89% |
| 1523 | Eg/Eucgr. 004011.2 | 63% (210/332) | 264-322 | PADEFSWRKYGQKPI KGSPFPRGYYKCSTM RGCPARKHVERAPDD PTMLIVTYEGEHRH | 1553 | 89% |
| 1529 | Zm/GRMZM2G 071907_T01 | 50% (159/316) | 211-269 | PSDEYSWRKYGQKPI KGSPYPRGYYKCSTV RGCPARKHVERATDD PAMLVVTYEGEHRH | 1556 | 88% |
| 1517 | SI/Solyc12g096 350.1.1 | 47% (160/340) | 258-316 | PGDEFSWRKYGQKPI KGSKYPRGYYKCSSL RGCPARKHVERAMDD PTMLIVTYEDEHCH | 1550 | 83% |
| 1525 | Os/LOC_Os08g 13840.1 | 46% (153/327) | 241-299 | PADEYSWRKYGQKPI KGSPYPRGYYRCSTV KGCPARKHVERAADD PATLVVTYEGDHRH | 1554 | 81% |

TABLE 19-continued

Conserved WRKY DNA-binding Domain of
WRKY17 and closely related sequences

| Col. 1 SEQ ID NO: | Col. 2 Species/ Identifier | Col. 3 Percent identity of polypeptide in Col. 1 to WRKY17 | Col. 4 WRKY DNA-binding Domain in amino acid coordinates | Col. 5 WRKY DNA-binding Domain | Col. 6 SEQ ID NO: of WRKY DNA-binding Domain | Col. 7 Percent identity of WRKY DNA-binding Domain in Col. 5 to WRKY DNA-binding Domain of WRKY17 |
|---|---|---|---|---|---|---|
| 1527 | Os/LOC_Os08g 13840.2 | 46% (153/327) | 241-299 | PADEYSWRKYGQKPI KGSPYPRGYYRCSTV KGCPARKHVERAADD PATLVVTYEGDHRH | 1555 | 81% |

Species abbreviations for Tables 18 and 19:
At—*Arabidopsis thaliana*;
Cc—*Citrus x clementina*;
Eg—*Eucalyptus grandis*;
Gm—*Glycine max*;
Os—*Ouzel sativa*;
Sl—*Solanum lycopersicum*;
Zm—*Zea mays*

Sequences that are functionally-related and/or closely-related to the polypeptides in Tables 18 and 19 may be created artificially, semi-synthetically, or may occur naturally by having descended from the same ancestral sequence as the disclosed WRKY17-related sequences, where the polypeptides have the function of conferring increased photosynthetic resource use efficiency to plants.

As shown in FIG. 33B, these "functionally-related and/or closely-related" WRKY17 clade polypeptides generally contain a consensus sequence of the WRKY17 clade, SEQ ID NO: 1558 which comprises the conserved primary "C-region" motif (calmodulin-binding domain):

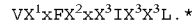

Also provided in FIG. 33B, these "functionally-related and/or closely-related" WRKY17 clade polypeptides also generally contain a consensus sequence of SEQ ID NO: 1559, which comprises the "HARF domain' within which is the "GHARFRR domain":

As shown in FIG. 33F, the instant "functionally-related and/or closely-related" WRKY17 clade polypeptides also generally contain a consensus sequence which comprises the "Plant Zinc Cluster Domain" SEQ ID NO: 1560:

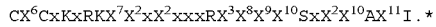

The consensus WRKY DNA-binding domain present in WRKY17 clade member proteins is identifiable as SEQ ID NO: 1561 in FIG. 33F to FIG. 33G:

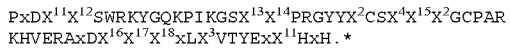

*In the above consensus sequences of SEQ ID NO: 1558-1561, x represents any amino acid;
$X^1$ is S or A; $X^2$ is K or R; $X^3$ is I, V, L, or M; $X^4$ is S or T; $X^5$ is G, A or S; $X^6$ is H or Q; $X^7$ is N, Q, or A; $X^8$ is P or A; $X^9$ is V or A; $X^{10}$ is I, V, L, M, or A; $X^{11}$ is D or E; $X^{12}$ is Y or F; $X^{13}$ is P or K; $X^{14}$ is Y, F, or H; $X^{15}$ is I, V, L, M, or F; $X^{16}$ is D, N or E; $X^{17}$ is P or S; and $X^{18}$ is S, A, or T. Alternative consensus sequences comprising the above with conservative substitutions found in Table 1 are also envisaged and may be expected to provide equivalent function(s).

The presence of one or more of these consensus sequences and/or these amino acid residues is correlated with conferring of improved or increased photosynthetic resource use efficiency to a plant when the expression level of the polypeptide is altered in a plant by being reduced, knocked-out, or overexpressed. A WRKY17 clade polypeptide sequence that is "functionally-related and/or closely-related" to the listed full length protein sequences or domains provided in Tables 18 or 19 may also have at least 46%, 47%, 49%, 50%, 59%, 61%, 62%, 63%, 64%, 74%, or about 100% amino acid identity to SEQ ID NO: 1507, and/or at least 43%, 50%, 58%, 62%, 64%, 68%, 70%, 86%, or about 100% amino acid identity to the "Plant Zinc Cluster Domain" of SEQ ID NO: 1507, and/or at least 81%, 83%, 88%, 89%, 91%, 93%, 96%, or about 100% amino acid identity to the "WRKY DNA-binding Domain" of SEQ ID NO: 1507 in its amino acid sequence to the entire length of a listed sequence or to a listed "Plant Zinc Cluster Domain", or to a listed ""WRKY DNA-binding Domain", or to the amino acid sequence of SEQ ID NO: 1507, 1509, 1511, 1513, 1515, 1517, 1519, 1521, 1523, 1525, 1527, 1529, or 1531, or 1532-1557. The presence of the disclosed conserved "Plant Zinc Cluster" and "WRKY DNA-binding" domains in the polypeptide sequence (for example, SEQ ID NO: 1507-1557 or 1558-1561), is correlated with the conferring of improved or increased photosynthetic resource use efficiency to a plant when the expression level of the polypeptide is altered in a plant by being reduced, knocked-out, or overexpressed. All of the sequences that adhere to these functional and sequential relationships are herein referred to as "WRKY17 clade polypeptides" or "WRKY17 clade polypeptides", or which fall within the "WRKY17 clade" or "G866 clade" exemplified in the phylogenetic tree in FIG. 32 as those polypeptides bounded by LOC_Os08g13840.1 and Solyc12g096350.1.1 (indicated by the box around these sequences).

TABLE 20

Conserved 'Z-C2H2 domain 1' of ZAT11 and closely related sequences

| Col. 1 SEQ ID NO: | Col. 2 Species/ Identifier | Col. 3 Percent identity of polypeptide in Col. 1 to ZAT11 | Col. 4 Z-C2H2 domain 1 in amino acid coordinates | Col. 5 Conserved Z-C2H2 domain 1 | Col. 6 SEQ ID NO: of Z-C2H2 domain 1 | Col. 7 Percent identity of first Z-C2H2 in Col. 5 to Z-C2H2 domain 1 of ZAT11 |
|---|---|---|---|---|---|---|
| 1591 | At/ZAT11 or AT2G37430.1 | 100% (178/178) | 47-72 | FECKTCNKRFSSF QALGGHRASHKKP | 1618 | 100% (26/26) |
| 1615 | Eucgr. A01231.1 | 48% (83/172) | 28-53 | FECKTCNRRFSSF QALGGHRASHKKP | 1630 | 96% (25/26) |
| 1603 | Glyma10g0521 0.1 | 46% (85/183) | 47-72 | FECKTCNRKFSSF QALGGHRASHKKP | 1624 | 92% (24/26) |
| 1593 | AT3G53600.1 | 63% (113/179) | 49-74 | FECKTCNRKFDSF QALGGHRASHKKP | 1619 | 88% (23/26) |
| 1601 | Glyma13g1955 0.1 | 51% (83/160) | 34-59 | FECMTCNLKFSSF QALGGHRASHKKP | 1623 | 88% (23/26) |
| 1605 | Glyma13g1957 0.1 | 45% (83/184) | 46-71 | FECKTCNRKFPSF QALGGHRASHKKP | 1625 | 88% (23/26) |
| 1611 | Clementine0.9_ 035547m | 50% (83/166) | 44-69 | FECKTCNRQFPSF QALGGHRASHKKP | 1628 | 88% (23/26) |
| 1613 | Eucgr. A01230.1 | 46% (84/179) | 42-67 | YECKTCNRQFSSF QALGGHRASHKKP | 1629 | 88% (23/26) |
| 1595 | Glyma03g3305 0.1 | 51% (86/168) | 41-66 | FECKTCNRKFSSF QALGGHRASHKRS | 1620 | 88% (22/25) |
| 1597 | Glyma19g3574 0.1 | 50% (87/171) | 41-66 | FECKTCNRKFSSF QALGGHRASHKRS | 1621 | 88% (22/25) |
| 1599 | Glyma10g0518 0.1 | 47% (81/169) | 37-62 | FECMTCNRKFTSF QALGGHRASHKKP | 1622 | 84% (22/26) |
| 1617 | Eucgr. A01232.1 | 48% (92/188) | 43-68 | FKCKTCNRQFPSF QALGGHRASHKKP | 1631 | 84% (22/26) |
| 1607 | Glyma10g0519 0.1 | 41% (77/185) | 42-67 | FECKTCNRKFNSF QALGGHRASHNKR | 1626 | 84% (21/25) |
| 1609 | Glyma13g1956 0.1 | 42% (77/180) | 41-66 | FECKTCNRKFNSF QALGGHRACHNKR | 1627 | 80% (20/25) |

TABLE 21

Conserved 'Z-C2H2 domain 2' of ZAT11 and closely related sequences

| Col. 1 SEQ ID NO: | Col. 2 Species/ Identifier | Col. 3 Percent identity of polypeptide in Col. 1 to ZAT11 | Col. 4 Z-C2H2 domain 2 in amino acid coordinates | Col. 5 Conserved Z-C2H2 domain 2 | Col. 6 SEQ ID NO: of second Z-C2H2 domain | Col. 7 Percent identity of second Z-C2H2 domain in Col. 5 to Z-C2H2 domain 2 of ZAT11 |
|---|---|---|---|---|---|---|
| 1591 | At/ZAT11 or AT2G37430.1 | 100% (178/178) | 93-118 | FHKCSICSQSFGT GQALGGHMRRHRS | 1632 | 100% (26/26) |
| 1593 | AT3G53600.1 | 63% (113/179) | 92-117 | MHKCTICDQMFGT GQALGGHMRKHRT | 1633 | 76% (20/26) |
| 1609 | Glyma13g1956 0.1 | 42% (77/180) | 93-118 | MHNCSICGQGFSL GQALGGHMRRHRA | 1641 | 76% (19/25) |

TABLE 21-continued

Conserved 'Z-C2H2 domain 2' of ZAT11 and closely related sequences

| Col. 1 SEQ ID NO: | Col. 2 Species/ Identifier | Col. 3 Percent identity of polypeptide in Col. 1 to ZAT11 | Col. 4 Z-C2H2 domain 2 in amino acid coordinates | Col. 5 Conserved Z-C2H2 domain 2 | Col. 6 SEQ ID NO: of second Z-C2H2 domain | Col. 7 Percent identity of second Z-C2H2 domain in Col. 5 to Z-C2H2 domain 2 of ZAT11 |
|---|---|---|---|---|---|---|
| 1611 | Clementine0.9_035547m | 50% (83/166) | 89-114 | LHECSICGQEFAM GQALGGHMRRHRI | 1642 | 76% (19/25) |
| 1607 | Glyma10g05190.1 | 41% (77/185) | 96-121 | IHNCFICGQGFSL GQALGGHMRRHRD | 1640 | 75% (18/24) |
| 1595 | Glyma03g33050.1 | 51% (86/168) | 88-113 | MHECSICGQEFSL GQALGGHMRRHRT | 1634 | 73% (19/26) |
| 1597 | Glyma19g35740.1 | 50% (87/171) | 89-114 | MHECSICGQEFSL GQALGGHMRRHRT | 1635 | 73% (19/26) |
| 1617 | Eucgr.A01232.1 | 48% (92/188) | 91-116 | MHECSICGLKFSL GQALGGHMRRHRV | 1645 | 72% (18/25) |
| 1601 | Glyma13g19550.1 | 51% (83/160) | 78-103 | KHECSICGREFTL GQALGGHMKKHRI | 1637 | 66% (16/24) |
| 1603 | Glyma10g05210.1 | 46% (85/183) | 90-115 | MHECSICGMEFSL GQALGGHMRKHRG | 1638 | 65% (17/26) |
| 1605 | Glyma13g19570.1 | 45% (83/184) | 94-119 | MHECSICGMEFSL GQALGGHMRKHRG | 1639 | 65% (17/26) |
| 1615 | Eucgr.A01231.1 | 48% (83/172) | 77-102 | MHECSMCGLKFAS GQALGGHMRRHRA | 1644 | 65% (17/26) |
| 1613 | Eucgr.A01230.1 | 46% (84/179) | 90-115 | MHECSVCGLKFAL GQALGGHMRKHRA | 1643 | 64% (16/25) |
| 1599 | Glyma10g05180.1 | 47% (81/169) | 81-106 | KHECTICGREFTL GQALGGHMKKHRI | 1636 | 62% (15/24) |

Species abbreviations for Tables 20 and 21:
At—*Arabidopsis thaliana*;
Cc—*Citrus clementina*;
Eg—*Eucalyptus grandis*;
Gm—*Glycine max*

Sequences that are functionally-related and/or closely-related to the polypeptides in Tables 20 and 21 may be created artificially, semi-synthetically, or may occur naturally by having descended from the same ancestral sequence as the disclosed ZAT11-related sequences, where the polypeptides have the function of conferring increased photosynthetic resource use efficiency to plants.

As shown in FIG. 36B, these "functionally-related and/or closely-related" ZAT11 clade polypeptides also generally contain a consensus Z-C2H2-1 sequence, SEQ ID NO: 1646:

$X^1xCxTCNxX^2FxSFQALGGHRAX^3HX^4X^5X^5$.*

Figure 36D:
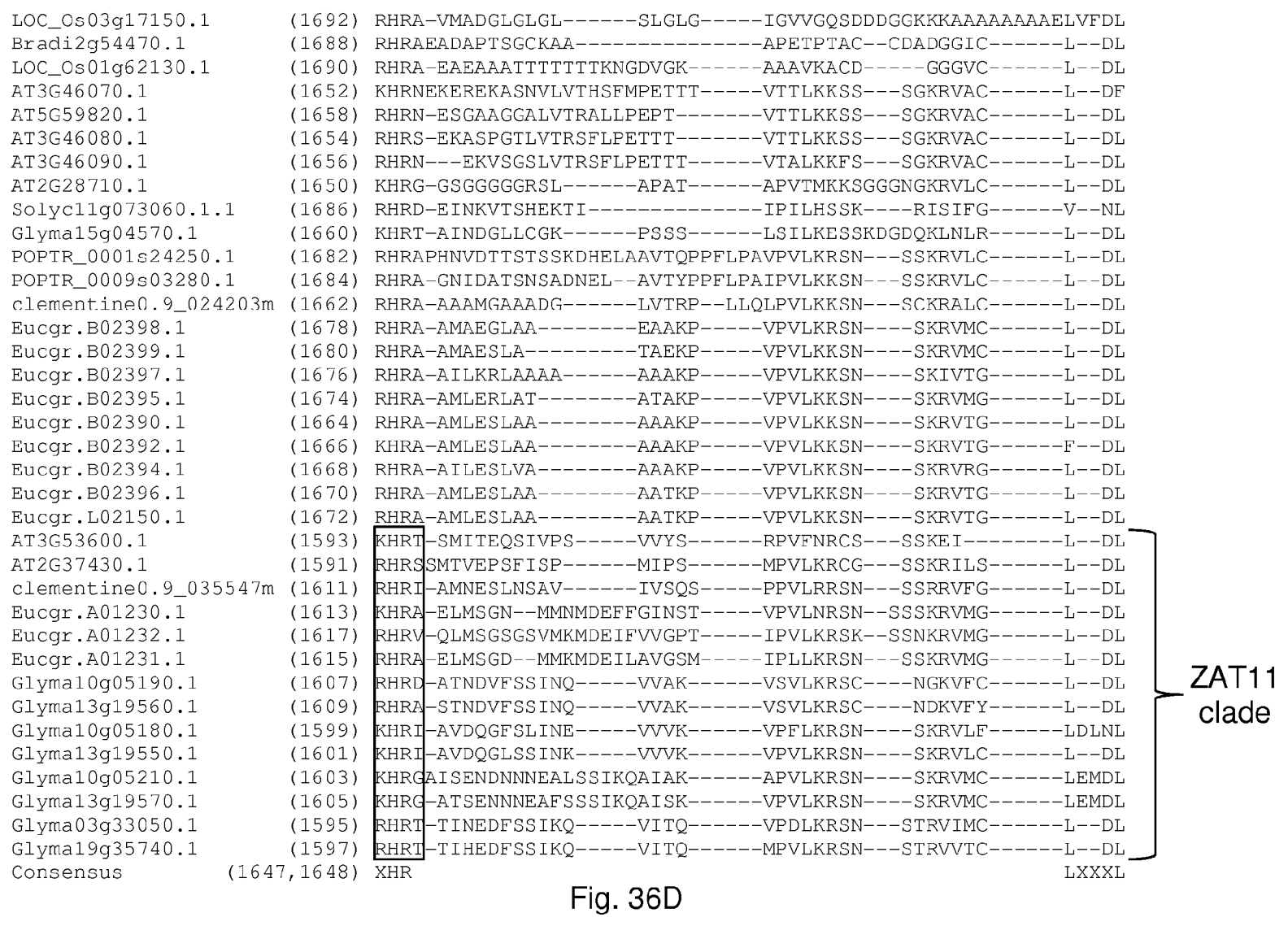

As shown in FIG. 36C-FIG. 36D, the instant "functionally-related and/or closely-related" ZAT11 clade polypeptides also generally contain a consensus Z-C2H2-2 sequence, SEQ ID NO: 1647:

$HxCxX^6CxxxFxxGQALGGHMX^5X^5HR$.*

There is also a motif near the c-terminus of ZAT11 clade member proteins that is identifiable as SEQ ID NO: 1648 (FIG. 36D-FIG. 36E):

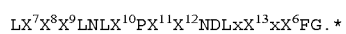

$LX^7X^8X^9LNLX^{10}PX^{11}X^{12}NDLxX^{13}xX^6FG$.*

*In the above consensus sequences of SEQ ID NO: 1646-1648, x represents any amino acid; $X^1$ is F or Y; $X^2$ is K, R, or Q; $X^3$ is S or C; $X^4$ is N or absent; $X^5$ is K or R; $X^6$ is I, L, V, or M; $X^7$ is E, D, or absent; $X^8$ is L, M or absent; $X^9$ is D or N; $X^{10}$ is T or S; $X^{11}$ is L or F; $X^{12}$ is E or Q; and $X^{13}$ is L or absent. Alternative consensus sequences comprising the above with conservative substitutions found in Table 1 are also envisaged and may be expected to provide equivalent function(s).

The presence of one or more of these consensus sequences and/or these amino acid residues is correlated with conferring of improved or increased photosynthetic resource use efficiency to a plant when the expression level of the polypeptide is altered in a plant by being reduced, knocked-out, or overexpressed. A ZAT11 clade polypeptide sequence that is "functionally-related and/or closely-related" to the listed full length protein sequences or domains provided in Tables 20 or 21 may also have at least 41%, 42%, 45%, 46%, 47%, 48%, 50%, 51%, 63%, or about 100% amino acid identity to SEQ ID NO: 1591, and/or at least 80%, 84%, 88%, 92%, 96%, or about 100% amino acid identity to the first Z-C2H2 domain of SEQ ID NO: 1591, and/or at least 62%, 64%, 65%, 66%, 72%, 73%, 75%, 76%, or about 100% amino acid identity to the second Z-C2H2 domain of SEQ ID NO: 1591 in its amino acid sequence to the entire length of a listed sequence or to a listed first Z-C2H2 domain, or to a listed second Z-C2H2 domain, or to the amino acid sequence of SEQ ID NO: 1591, 1593, 1595, 1597, 1599, 1601, 1603, 1605, 1607, 1609, 1611, 1613, 1615, or 1617, or 1618-1645. The presence of the disclosed conserved first Z-C2H2 domains and/or second Z-C2H2 domains in the polypeptide sequence (for example, SEQ ID NO: 1618-1647), is correlated with the conferring of improved or increased photosynthetic resource use efficiency to a plant when the expression level of the polypeptide is altered in a plant by being reduced, knocked-out, or overexpressed. All of the sequences that adhere to these functional and sequential relationships are herein referred to as "ZAT11 clade polypeptides" or "ZAT11 clade polypeptides", or which fall within the "ZAT11 clade" or "G355 clade" exemplified in the phylogenetic tree in FIG. 35 as those polypeptides bounded by Bradi1g03810.1 and Solyc05g054650.1.1.

Identifying Polynucleotides or Nucleic Acids by Hybridization.

Polynucleotides homologous to the sequences illustrated in the Sequence Listing and tables can be identified, e.g., by hybridization to each other under stringent or under highly stringent conditions. Stringency is influenced by a variety of factors, including temperature, salt concentration and composition, organic and non-organic additives, solvents, etc. present in both the hybridization and wash solutions and incubations, and the number of washes, as described in more detail in the references cited below (e.g., Sambrook et al., 1989. supra; Berger and Kimmel, eds., 1987. *Methods Enzymol.* 152: 507-511; Anderson and Young, 1985. "Quantitative Filter Hybridisation", In: Hames and Higgins, ed., *Nucleic Acid Hybridisation, A Practical Approach*. Oxford, IRL Press, 73-111), each of which are incorporated herein by reference. Conditions that are highly stringent, and means for achieving them, are also well known in the art and described in, for example, Sambrook et al., 1989. supra; Berger and Kimmel, eds., 1987. *Meth. Enzymol.* 152:467-469; and Anderson and Young, 1985. supra.

Also provided in the instant description are polynucleotide sequences that are capable of hybridizing to the claimed polynucleotide sequences, including any of the polynucleotides within the Sequence Listing, and fragments thereof under various conditions of stringency (see, for example, Wahl and Berger, 1987. *Methods Enzymol.* 152: 399-407; Berger and Kimmel, ed., 1987. *Methods Enzymol.* 152:507-511). In addition to the nucleotide sequences listed in the Sequence Listing, full length cDNA, orthologs, and paralogs of the present nucleotide sequences may be identified and isolated using well-known methods. The cDNA libraries, orthologs, and paralogs of the present nucleotide sequences may be screened using hybridization methods to determine their utility as hybridization target or amplification probes.

Stability of DNA duplexes is affected by such factors as base composition, length, and degree of base pair mismatch. Hybridization conditions may be adjusted to allow DNAs of different sequence relatedness to hybridize. The melting temperature ($T_m$) is defined as the temperature when 50% of the duplex molecules have dissociated into their constituent single strands. The melting temperature of a perfectly matched duplex, where the hybridization buffer contains formamide as a denaturing agent, may be estimated by the following equations:

$$T_m(°\text{ C.})=81.5+16.6(\log [\text{Na+}])+0.41(\% \text{ G+C})-0.62(\% \text{ formamide})-500/L \quad \text{(I) DNA-DNA:}$$

$$T_m(°\text{ C.})=79.8+18.5(\log [\text{Na+}])+0.58(\% \text{ G+C})+0.12(\% \text{ G+C})^2-0.5(\% \text{ formamide})-820/L \quad \text{(II) DNA-RNA:}$$

$$T_m(°\text{ C.})=79.8+18.5(\log [\text{Na+}])+0.58(\% \text{ G+C})+0.12(\% \text{ G+C})^2-0.35(\% \text{ formamide})-820/L \quad \text{(III) RNA-RNA:}$$

where L is the length of the duplex formed, [Na+] is the molar concentration of the sodium ion in the hybridization or washing solution, and % G+C is the percentage of (guanine+cytosine) bases in the hybrid. For imperfectly matched hybrids, approximately 1° C. is required to reduce the melting temperature for each 1% mismatch.

Hybridization experiments are generally conducted in a buffer of pH between 6.8 to 7.4, although the rate of hybridization is nearly independent of pH at ionic strengths likely to be used in the hybridization buffer (Anderson and Young, 1985. supra). In addition, one or more of the following may be used to reduce non-specific hybridization: sonicated salmon sperm DNA or another non-complementary DNA, bovine serum albumin, sodium pyrophosphate, sodium dodecylsulfate (SDS), polyvinyl-pyrrolidone, ficoll and Denhardt's solution. Dextran sulfate and polyethylene glycol 6000 act to exclude DNA from solution, thus raising the effective probe DNA concentration and the hybridization signal within a given unit of time. In some instances, conditions of even greater stringency may be desirable or required to reduce non-specific and/or background hybridization. These conditions may be created with the use of higher temperature, lower ionic strength and higher concentration of a denaturing agent such as formamide.

Stringency conditions can be adjusted to screen for moderately similar fragments such as homologous sequences from distantly related organisms, or to highly similar fragments such as genes that duplicate functional enzymes from closely related organisms. The stringency can be adjusted either during the hybridization step or in the post-hybridization washes. Salt concentration, formamide concentration, hybridization temperature and probe lengths are variables that can be used to alter stringency (as described by the formula above). As a general guideline, high stringency is typically performed at $T_m-5°$ C. to $T_m-20°$ C., moderate stringency at $T_m-20°$ C. to $T-35°$ C. and low stringency at $T_m-35°$ C. to $T_m-50°$ C. for duplex >150 base pairs. Hybridization may be performed at low to moderate stringency (25-50° C. below $T_m$), followed by post-hybridization washes at increasing stringencies. Maximum rates of hybridization in solution are determined empirically to occur at $T_m-25°$ C. for DNA-DNA duplex and $T_m-15°$ C. for RNA-DNA duplex. Optionally, the degree of dissociation may be assessed after each wash step to determine the need for subsequent, higher stringency wash steps.

High stringency conditions may be used to select for nucleic acid sequences with high degrees of identity to the disclosed sequences. An example of stringent hybridization conditions obtained in a filter-based method such as a Southern or Northern blot for hybridization of complementary nucleic acids that have more than 100 complementary residues is about 5° C. to 20° C. lower than the thermal melting point ($T_m$) for the specific sequence at a defined ionic strength and pH. Conditions used for hybridization may include about 0.02 M to about 0.15 M sodium chloride, about 0.5% to about 5% casein, about 0.02% SDS or about 0.1% N-laurylsarcosine, about 0.001 M to about 0.03 M sodium citrate, at hybridization temperatures between about 50° C. and about 70° C. More preferably, high stringency conditions are about 0.02 M sodium chloride, about 0.5% casein, about 0.02% SDS, about 0.001 M sodium citrate, at a temperature of about 50° C. Nucleic acid molecules that hybridize under stringent conditions will typically hybridize to a probe based on either the entire DNA molecule or selected portions, e.g., to a unique subsequence, of the DNA.

Stringent salt concentration will ordinarily be less than about 750 mM NaCl and 75 mM trisodium citrate. Increasingly stringent conditions may be obtained with less than about 500 mM NaCl and 50 mM trisodium citrate, to even greater stringency with less than about 250 mM NaCl and 25 mM trisodium citrate. Low stringency hybridization can be obtained in the absence of organic solvent, e.g., formamide, whereas high stringency hybridization may be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. with formamide present. Varying additional parameters, such as hybridization time, the concentration of detergent, e.g., sodium dodecyl sulfate (SDS) and ionic strength, are well known to those skilled in the art. Various levels of stringency are accomplished by combining these various conditions as needed.

The washing steps that follow hybridization may also vary in stringency; the post-hybridization wash steps primarily determine hybridization specificity, with the most critical factors being temperature and the ionic strength of the final wash solution. Wash stringency can be increased by decreasing salt concentration or by increasing temperature. Stringent salt concentration for the wash steps will preferably be less than about 30 mM NaCl and 3 mM trisodium citrate, and most preferably less than about 15 mM NaCl and 1.5 mM trisodium citrate.

Thus, high stringency hybridization and wash conditions that may be used to bind and remove polynucleotides with less than the desired homology to the nucleic acid sequences or their complements that encode the present polypeptides include, for example:

6×SSC at 65° C.;
50% formamide, 4×SSC at 42° C.; or
0.5×SSC, 0.1% SDS at 65° C.;

with, for example, two wash steps of 10-30 minutes each. Useful variations on these conditions will be readily apparent to those skilled in the art.

A person of skill in the art would not expect substantial variation among polynucleotide species provided with the present description because the highly stringent conditions set forth in the above formulae yield structurally similar polynucleotides.

If desired, one may employ wash steps of even greater stringency, including about 0.2×SSC, 0.1% SDS at 65° C. and washing twice, each wash step being about 30 minutes, or about 0.1×SSC, 0.1% SDS at 65° C. and washing twice for 30 minutes. The temperature for the wash solutions will ordinarily be at least about 25° C., and for greater stringency at least about 42° C. Hybridization stringency may be increased further by using the same conditions as in the hybridization steps, with the wash temperature raised about 3° C. to about 5° C., and stringency may be increased even further by using the same conditions except the wash temperature is raised about 6° C. to about 9° C. For identification of less closely related homologs, wash steps may be performed at a lower temperature, e.g., 50° C.

An example of a low stringency wash step employs a solution and conditions of at least 25° C. in 30 mM NaCl, 3 mM trisodium citrate, and 0.1% SDS over 30 minutes. Greater stringency may be obtained at 42° C. in 15 mM NaCl, with 1.5 mM trisodium citrate, and 0.1% SDS over 30 minutes. Even higher stringency wash conditions are obtained at 65° C.-68° C. in a solution of 15 mM NaCl, 1.5 mM trisodium citrate, and 0.1% SDS. Wash procedures will generally employ at least two final wash steps. Additional variations on these conditions will be readily apparent to those skilled in the art (see, for example, U.S. patent publication no. 20010010913).

Stringency conditions can be selected such that an oligonucleotide that is perfectly complementary to the coding oligonucleotide hybridizes to the coding oligonucleotide with at least about a 5-10× higher signal to noise ratio than the ratio for hybridization of the perfectly complementary oligonucleotide to a nucleic acid encoding a polypeptide known as of the filing date of the application. It may be desirable to select conditions for a particular assay such that a higher signal to noise ratio, that is, about 15× or more, is obtained. Accordingly, a subject nucleic acid will hybridize to a unique coding oligonucleotide with at least a 2× or greater signal to noise ratio as compared to hybridization of the coding oligonucleotide to a nucleic acid encoding known polypeptide. The particular signal will depend on the label used in the relevant assay, e.g., a fluorescent label, a colorimetric label, a radioactive label, or the like. Labeled hybridization or PCR probes for detecting related polynucleotide sequences may be produced by oligolabeling, nick translation, end-labeling, or PCR amplification using a labeled nucleotide.

The present description also provides polynucleotide sequences that are capable of hybridizing to the claimed polynucleotide sequences, including any of the polynucleotides within the Sequence Listing, and fragments thereof under various conditions of stringency (see, for example, Wahl and Berger, 1987, supra, pages 399-407; and Kimmel, 1987. *Meth. Enzymol.* 152, 507-511). In addition to the nucleotide sequences in the Sequence Listing, full length cDNA, orthologs, and paralogs of the present nucleotide sequences may be identified and isolated using well-known methods. The cDNA libraries, orthologs, and paralogs of the present nucleotide sequences may be screened using hybridization methods to determine their utility as hybridization target or amplification probes.

EXAMPLES

It is to be understood that this description is not limited to the particular devices, machines, materials and methods described. Although particular embodiments are described, equivalent embodiments may be used to practice the claims.

The specification, now being generally described, will be more readily understood by reference to the following examples, which are included merely for purposes of illustration of certain aspects and embodiments of the present description and are not intended to limit the claims or description. It will be recognized by one of skill in the art that a polypeptide that is associated with a particular first trait may also be associated with at least one other, unrelated and inherent second trait which was not predicted by the first trait.

Example I

Plant Genotypes and Vector and Cloning Information

A variety of constructs may be used to modulate the activity of regulatory polypeptides (RPs), and to test the activity of orthologs and paralogs in transgenic plant material. This platform provides the material for all subsequent analysis.

An individual plant "genotype" refers to a set of plant lines containing a particular construct or knockout (for example, this might be 35S lines for a given gene sequence (GID, Gene Identifier) being tested, 35S lines for a paralog or ortholog of that gene sequence, lines for an RNAi construct, lines for a GAL4 fusion construct, or lines in which expression of the gene sequence is driven from a particular promoter that enhances expression in particular cell, tissue or condition). For a given genotype arising from a particular transformed construct, multiple independent transgenic lines may be examined for morphological and physiological phenotypes. Each individual "line" (also sometimes known as an "event") refers to the progeny plant or plants deriving from the stable integration of the transgene(s), carried within the T-DNA borders contained within a transformation construct, into a specific location or locations within the genome of the original transformed cell. It is well known in the art that different lines deriving from transformation with a given transgene may exhibit different levels of expression of that transgene due to so called "position effects" of the surrounding chromatin at the locus of integration in the genome, and therefore it is necessary to examine multiple lines containing each construct of interest.

(1) Overexpression/Tissue-Enhanced/Conditional Expression.

Expression of a given regulatory protein from a particular promoter, for example a photosynthetic tissue-enhanced promoter (e.g., a green tissue- or leaf-enhanced promoter), is achieved either by a direct-promoter fusion construct in which that regulatory protein is cloned directly behind the promoter of interest or by a two component system.

The Two-Component Expression System.

For the two-component system, two separate constructs are used: Promoter::LexA-GAL4TA and opLexA::RP. The first of these (Promoter::LexA-GAL4TA) comprises a desired promoter cloned in front of a LexA DNA binding domain fused to a GAL4 activation domain. The construct vector backbone (pMEN48, also known as P5375) also carries a kanamycin resistance marker, along with an opLexA::GFP (green fluorescent protein) reporter. Transgenic lines are obtained containing this first component, and a line is selected that shows reproducible expression of the reporter gene in the desired pattern through a number of generations. A homozygous population is established for that line, and the population is supertransformed with the second construct (opLexA::RP) carrying the regulatory protein of interest cloned behind a LexA operator site. This second construct vector backbone (pMEN53, also known as P5381) also contains a sulfonamide resistance marker.

Conditional Expression.

Various promoters can be used to overexpress disclosed polypeptides in plants to confer improved photosynthetic resource use efficiency. However, in some cases, there may be limitations in the use of various proteins that confer increased photosynthetic resource use efficiency when the proteins are overexpressed. Negative side effects associated with constitutive overexpression such as small size, delayed growth, increased disease sensitivity, and development and alteration in flowering time are not uncommon. A number of stress-inducible promoters can be used promote protein expression during the periods of stress, and therefore may be used to induce overexpression of polypeptides that can confer improved stress tolerance when they are needed without the adverse developmental or morphological effects that may be associated with their constitutive overexpression.

Promoters that drive protein expression in response to stress can be used to regulate the expression of the disclosed polypeptides to confer photosynthetic resource use efficiency to plants. The promoter may regulate expression of a disclosed polypeptide to an effective level in a photosynthetic tissue. Effective level in this regard refers to an expression level that confers greater photosynthetic resource use efficiency in the transgenic plant relative to the control plant that, for example, does not comprise a recombinant polynucleotide that encodes the disclosed polypeptide. Optionally, the promoter does not regulate protein expression in a constitutive manner.

Such promoters include, but are not limited to, the sequences located in the promoter regions of At5g52310 (RD29A), At5g52300, AT1G16850, At3g46230, AT1G52690, At2g37870, AT5G43840, At5g66780, At3g17520, and At4g09600.

In addition, promoters with expression specific to or enhanced in particular cells or tissue types may be used to express a given regulatory protein only in these cells or tissues. Examples of such promoter types include but are not limited to promoters expressed in green tissue, guard cell, epidermis, whole root, root hairs, vasculature, apical meristems, and developing leaves.

Table 22 lists a number of photosynthetic tissue-enhanced promoters, specifically, mesophyll tissue-enhanced promoters from rice, that may be used to regulate expression of polynucleotides and polypeptides found in the Sequence Listing and structurally and functionally-related sequences. Promoters that may be used to drive expression of polynucleotides and polypeptides found in the Sequence Listing and structurally and functionally-related sequences included, but are not limited to, promoter sequences listed in Table 22, as well as promoters that are at least 80%, 81%, 82%, 83%, 84%, 85%, 86%, 87%, 88%, 89%, 90%, 91%, 92%, 93%, 94%, 95%, 96%, 97%, 98%, 99%, or about 100% identical to SEQ ID NO: 1693-1719, or comprise a functional fragment of promoters that are at least 80%, 81%, 82%, 83%, 84%, 85%, 86%, 87%, 88%, 89%, 90%, 91%, 92%, 93%, 94%, 95%, 96%, 97%, 98%, 99%, or about 100% identical to SEQ ID NO: 1693-1719.

TABLE 22

Rice Genes with Photosynthetic Tissue-Enhanced Promoters

| SEQ ID NO: | Rice Gene Identifier of Photosynthetic Tissue-Enhanced Promoter |
|---|---|
| 1696 | Os02g09720 |
| 1697 | Os05g34510 |
| 1698 | Os11g08230 |
| 1699 | Os01g64390 |
| 1700 | Os06g15760 |
| 1701 | Os12g37560 |
| 1702 | Os03g17420 |
| 1703 | Os04g51000 |
| 1704 | Os01g01960 |
| 1705 | Os05g04990 |

TABLE 22-continued

Rice Genes with Photosynthetic Tissue-Enhanced Promoters

| SEQ ID NO: | Rice Gene Identifier of Photosynthetic Tissue-Enhanced Promoter |
|---|---|
| 1706 | Os02g44970 |
| 1707 | Os01g25530 |
| 1708 | Os03g30650 |
| 1709 | Os01g64910 |
| 1710 | Os07g26810 |
| 1711 | Os07g26820 |
| 1712 | Os09g11220 |
| 1713 | Os04g21800 |
| 1714 | Os10g23840 |
| 1715 | Os08g13850 |
| 1716 | Os12g42980 |
| 1717 | Os03g29280 |
| 1718 | Os03g20650 |
| 1719 | Os06g43920 |

Tissue-enhanced promoters that may be used to drive expression of polynucleotides and polypeptides found in the Sequence Listing and structurally and functionally-related sequences have also been described in U.S. patent publication no. 20110179520A1, incorporated herein by reference. Such promoters include, but are not limited to, *Arabidopsis* sequences located in the promoter regions of AT1G08465, AT1G10155, AT1G14190, AT1G24130, AT1G24735, AT1G29270, AT1G30950, AT1G31310, AT1G37140, AT1G49320, AT1G49475, AT1G52100, AT1G60540, AT1G60630, AT1G64625, AT1G65150, AT1G68480, AT1G68780, AT1G69180, AT1G77145, AT1G80580, AT2G03500, AT2G17950, AT2G19910, AT2G27250, AT2G33880, AT2G39850, AT3G02500, AT3G12750, AT3G15170, AT3G16340, AT3G27920, AT3G30340, AT3G42670, AT3G44970, AT3G49950, AT3G50870, AT3G54990, AT3G59270, AT4G00180, AT4G00480, AT4G12450, AT4G14819, AT4G31610, AT4G31615, AT4G31620, AT4G31805, AT4G31877, AT4G36060, AT4G36470, AT4G36850, AT4G37970, AT5G03840, AT5G12330, AT5G14070, AT5G16410, AT5G20740, AT5G27690, AT5G35770, AT5G39330, AT5G42655, AT5G53210, AT5G56530, AT5G58780, AT5G61070, and AT5G6491.

In addition to the sequences provided in the Sequence Listing or in this Example, a promoter region may include a fragment of the promoter sequences provided in the Sequence Listing or in this Example, or a complement thereof, wherein the promoter sequence, or the fragment thereof, or the complement thereof, regulates expression of a polypeptide in a plant cell, for example, in response to a biotic or abiotic stress, or in a manner that is enhanced or preferred in certain plant tissues.

(2) Knock-Out/Knock-Down

In some cases, lines mutated in a given regulatory protein may be analyzed. Where available, T-DNA insertion lines in a given gene are isolated and characterized. In cases where a T-DNA insertion line is unavailable, an RNA interference (RNAi) strategy is sometimes used.

Example II

Transformation Methods

Crop species that overexpress polypeptides of the instant description may produce plants with increased photosynthetic resource use efficiency and/or yield. Thus, polynucleotide sequences listed in the Sequence Listing recombined into, for example, one of the expression vectors of the instant description, or another suitable expression vector, may be transformed into a plant for the purpose of modifying plant traits for the purpose of improving yield, quality, and/or photosynthetic resource use efficiency. The expression vector may contain a constitutive, tissue-enhanced or inducible promoter operably linked to the polynucleotide. The cloning vector may be introduced into a variety of plants by means well known in the art such as, for example, direct DNA transfer or *Agrobacterium tumefaciens*-mediated transformation.

Transformation of Monocots.

Cereal plants including corn, wheat, rice, sorghum, barley, or other monocots may be transformed with the present polynucleotide sequences, including monocot or eudicot-derived sequences such as those presented in the present Tables, cloned into a vector such as pGA643 and containing a kanamycin-resistance marker, and expressed constitutively under, for example, the CaMV35S or COR15 promoters, or with tissue-enhanced or inducible promoters. The expression vectors may be one found in the Sequence Listing, or any other suitable expression vector may be similarly used. For example, pMEN020 may be modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

The cloning vector may be introduced into a variety of cereal plants by means well known in the art including direct DNA transfer or *Agrobacterium tumefaciens*-mediated transformation. The latter approach may be accomplished by a variety of means, including, for example, that of U.S. Pat. No. 5,591,616, in which monocotyledon callus is transformed by contacting dedifferentiating tissue with the *Agrobacterium* containing the cloning vector.

The sample tissues are immersed in a suspension of $3\times10^{-9}$ cells of *Agrobacterium* containing the cloning vector for 3-10 minutes. The callus material is cultured on solid medium at 25° C. in the dark for several days. The calli grown on this medium are transferred to a Regeneration Medium. Transfers are continued every two to three weeks (two or three times) until shoots develop. Shoots are then transferred to Shoot-Elongation Medium every 2-3 weeks. Healthy looking shoots are transferred to Rooting Medium and after roots have developed, the plants are placed into moist potting soil.

The transformed plants are then analyzed for the presence of the NPTII gene/kanamycin resistance by ELISA, using the ELISA NPTII kit from SPrime-3Prime Inc. (Boulder, Colo.).

It is also routine to use other methods to produce transgenic plants of most cereal crops (Vasil, 1994. *Plant Mol. Biol.* 25: 925-937) such as corn, wheat, rice, sorghum (Cassas et al., 1993. *Proc. Natl. Acad. Sci. USA* 90: 11212-11216), and barley (Wan and Lemeaux, 1994. *Plant Physiol.* 104: 37-48). DNA transfer methods such as the microprojectile method can be used for corn (Fromm et al., 1990. *Bio/Technol.* 8: 833-839; Gordon-Kamm et al., 1990. *Plant Cell* 2: 603-618; Ishida, 1990. *Nature Biotechnol.* 14:745-750), wheat (Vasil et al., 1992. *Bio/Technol.* 10:667-674; Vasil et al., 1993. *Bio/Technol.* 11:1553-1558; Weeks et al., 1993. *Plant Physiol.* 102:1077-1084), and rice (Christou, 1991. *Bio/Technol.* 9:957-962; Hiei et al., 1994. *Plant J.* 6:271-282; Aldemita and Hodges, 1996. *Planta* 199: 612-617; and Hiei et al., 1997. *Plant Mol. Biol.* 35:205-218). For most cereal plants, embryogenic cells derived from immature scutellum tissues are the preferred cellular targets for transformation (Hiei et al., 1997. supra; Vasil, 1994. supra). For transforming corn embryogenic cells derived from immature scutellar tissue using microprojectile bombardment, the A188XB73 genotype is the preferred genotype (Fromm et al., 1990. *Bio/Technol.* 8: 833-839; Gordon-Kamm et al., 1990. supra). After microprojectile bombardment the tissues are selected on phosphinothricin to identify the transgenic embryogenic cells (Gordon-Kamm et al., 1990. supra). Transgenic plants from transformed host plant cells may be regenerated by standard corn regeneration techniques (Fromm et al., 1990. *Bio/Technol.* 8: 833-839; Gordon-Kamm et al., 1990. supra).

Transformation of Dicots.

It is now routine to produce transgenic plants using most eudicot plants (see U.S. Pat. No. 8,273,954 (Rogers et al.) issued Sep. 25, 2012; Weissbach and Weissbach, 1989. *Methods for Plant Molecular Biology*, Academic Press; Gelvin et al., 1990. *Plant Molecular Biology Manual*, Kluwer Academic Publishers; Herrera-Estrella et al., 1983. *Nature* 303: 209; Bevan, 1984. *Nucleic Acids Res.* 12: 8711-8721; and Klee, 1985. *Bio/Technology* 3: 637-642). Methods for analysis of traits are routine in the art and examples are disclosed above.

Numerous protocols for the transformation of tomato and soy plants have been previously described, and are well known in the art. Gruber et al., in Glick and Thompson, 1993. *Methods in Plant Molecular Biology and Biotechnology*. eds., CRC Press, Inc., Boca Raton, describe several expression vectors and culture methods that may be used for cell or tissue transformation and subsequent regeneration. For soybean transformation, methods are described by Miki et al., 1993. in *Methods in Plant Molecular Biology and Biotechnology*, p. 67-88, Glick and Thompson, eds., CRC Press, Inc., Boca Raton; and U.S. Pat. No. 5,563,055 (Townsend and Thomas), issued Oct. 8, 1996.

There are a substantial number of alternatives to *Agrobacterium*-mediated transformation protocols, other methods for the purpose of transferring exogenous genes into soybeans or tomatoes. One such method is microprojectile-mediated transformation, in which DNA on the surface of microprojectile particles is driven into plant tissues with a biolistic device (see, for example, Sanford et al., 1987. *Part. Sci. Technol.* 5:27-37; Sanford, 1993. *Methods Enzymol.* 217: 483-509; Christou et al., 1992. *Plant. J.* 2: 275-281; Klein et al., 1987. *Nature* 327: 70-73; U.S. Pat. No. 5,015,580 (Christou et al), issued May 14, 1991; and U.S. Pat. No. 5,322,783 (Tomes et al.), issued Jun. 21, 1994).

Alternatively, sonication methods (see, for example, Zhang et al., 1991. *Bio/Technology* 9: 996-997); direct uptake of DNA into protoplasts using $CaCl_2$ precipitation, polyvinyl alcohol or poly-L-ornithine (see, for example, Hain et al., 1985. *Mol. Gen. Genet.* 199: 161-168; Draper et al., 1982. *Plant Cell Physiol.* 23: 451-458); liposome or spheroplast fusion (see, for example, Deshayes et al., 1985. *EMBO J.*, 4: 2731-2737; Christou et al., 1987. *Proc. Natl. Acad. Sci. USA* 84: 3962-3966); and electroporation of protoplasts and whole cells and tissues (see, for example, Donn et al. 1990. in *Abstracts of VIIth International Congress on Plant Cell and Tissue Culture IAPTC*, A2-38: 53; D'Halluin et al., 1992. *Plant Cell* 4: 1495-1505; and Spencer et al., 1994. *Plant Mol. Biol.* 24: 51-61) have been used to introduce foreign DNA and expression vectors into plants.

After a plant or plant cell is transformed (and the transformed host plant cell then regenerated into a plant), the transformed plant may propagated vegetatively or it may be crossed with itself or a plant from the same line, a non-transformed or wild-type plant, or another transformed plant from a different transgenic line of plants. Crossing provides the advantages of producing new and often stable transgenic varieties. Genes and the traits they confer that have been introduced into a tomato or soybean line may be moved into distinct line of plants using traditional backcrossing techniques well known in the art. Transformation of tomato plants may be conducted using the protocols of Koornneef et al, 1986. In *Tomato Biotechnology*: Alan R. Liss, Inc., 169-178, and in U.S. Pat. No. 6,613,962, the latter method described in brief here. Eight day old cotyledon explants are precultured for 24 hours in Petri dishes containing a feeder layer of *Petunia hybrida* suspension cells plated on MS medium with 2% (w/v) sucrose and 0.8% agar supplemented with 10 μM α-naphthalene acetic acid and 4.4 μM 6-benzylaminopurine. The explants are then infected with a diluted overnight culture of *Agrobacterium tumefaciens* containing an expression vector comprising a polynucleotide of the instant description for 5-10 minutes, blotted dry on sterile filter paper and cocultured for 48 hours on the original feeder layer plates. Culture conditions are as described above. Overnight cultures of *Agrobacterium tumefaciens* are diluted in liquid MS medium with 2% (w/v/) sucrose, pH 5.7, to an $OD_{600}$ of 0.8.

Following cocultivation, the cotyledon explants are transferred to Petri dishes with selective medium comprising MS medium with 4.56 μM zeatin, 67.3 μM vancomycin, 418.9 μM cefotaxime and 171.6 μM kanamycin sulfate, and cultured under the culture conditions described above. The explants are subcultured every three weeks onto fresh medium. Emerging shoots are dissected from the underlying callus and transferred to glass jars with selective medium without zeatin to form roots. The formation of roots in a kanamycin sulfate-containing medium is a positive indication of a successful transformation.

Transformation of soybean plants may be conducted using the methods found in, for example, U.S. Pat. No. 5,563,055 (Townsend et al., issued Oct. 8, 1996), described in brief here. In this method soybean seed is surface sterilized by exposure to chlorine gas evolved in a glass bell jar. Seeds are germinated by plating on 1/10 strength agar solidified medium without plant growth regulators and culturing at 28° C. with a 16 hour day length. After three or four days, seed may be prepared for cocultivation. The seedcoat is removed and the elongating radicle removed 3-4 mm below the cotyledons.

*Eucalyptus* is now considered an important crop that is grown for example to provide feedstocks for the pulp and paper and biofuel markets. This species is also amenable to transformation as described in PCT patent publication WO/2005/032241.

*Crambe* has been recognized as a high potential oilseed crop that may be grown for the production of high value oils. An efficient method for transformation of this species has been described in PCT patent publication WO 2009/067398 A1.

Overnight cultures of *Agrobacterium tumefaciens* harboring the expression vector comprising a polynucleotide of the instant description are grown to log phase, pooled, and concentrated by centrifugation. Inoculations are conducted in batches such that each plate of seed was treated with a newly resuspended pellet of *Agrobacterium*. The pellets are resuspended in 20 ml inoculation medium. The inoculum is poured into a Petri dish containing prepared seed and the cotyledonary nodes are macerated with a surgical blade. After 30 minutes the explants are transferred to plates of the same medium that has been solidified. Explants are embedded with the adaxial side up and level with the surface of the medium and cultured at 22° C. for three days under white fluorescent light. These plants may then be regenerated according to methods well established in the art, such as by moving the explants after three days to a liquid counter-selection medium (see U.S. Pat. No. 5,563,055).

The explants may then be picked, embedded and cultured in solidified selection medium. After one month on selective media transformed tissue becomes visible as green sectors of regenerating tissue against a background of bleached, less healthy tissue. Explants with green sectors are transferred to an elongation medium. Culture is continued on this medium with transfers to fresh plates every two weeks. When shoots are 0.5 cm in length they may be excised at the base and placed in a rooting medium.

Experimental Methods; Transformation of *Arabidopsis*.

Transformation of *Arabidopsis* is performed by an *Agrobacterium*-mediated protocol based on the method of Bechtold and Pelletier, 1998. Unless otherwise specified, all experimental work is performed using the Columbia ecotype.

Plant Preparation.

*Arabidopsis* seeds are gas sterilized and sown on plates with media containing 80% MS with vitamins, 0.3% sucrose and 1% Bacto™ agar. The plates are placed at 4° in the dark for the days then transferred to 24 hour light at 22° for 7 days. After 7 days the seedlings are transplanted to soil, placing individual seedlings in each pot. The primary bolts are cut off a week before transformation to break apical dominance and encourage auxiliary shoots to form. Transformation is typically performed at 4-5 weeks after sowing.

Bacterial Culture Preparation.

*Agrobacterium* stocks are inoculated from single colony plates or from glycerol stocks and grown with the appropriate antibiotics until saturation. On the morning of transformation, the saturated cultures are centrifuged and bacterial pellets are re-suspended in Infiltration Media (0.5×MS, 1× Gamborg's Vitamins, 5% sucrose, 200 μl/L Silwet® L77) until an $A_{600}$ reading of 0.8 is reached.

Transformation and Harvest of Transgenic Seeds.

The *Agrobacterium* solution is poured into dipping containers. All flower buds and rosette leaves of the plants are immersed in this solution for 30 seconds. The plants are laid on their side and wrapped to keep the humidity high. The plants are kept this way overnight at 22° C. and then the pots are turned upright, unwrapped, and moved to the growth racks. In most cases, the transformation process is repeated one week later to increase transformation efficiency.

The plants are maintained on the growth rack under 24-hour light until seeds are ready to be harvested. Seeds are harvested when 80% of the siliques of the transformed plants are ripe (approximately five weeks after the initial transformation). This seed is deemed $T_0$ seed, since it is obtained from the $T_0$ generation, and is later plated on selection plates (either kanamycin or sulfonamide). Resistant plants that are identified on such selection plates comprise the T1 generation, from which transgenic seed comprising an expression vector of interest may be derived.

Example III

Primary Screening Materials and Methods

Plant Growth Conditions.

Seeds from *Arabidopsis* lines are chlorine gas sterilized using a standard protocol and spread onto plates containing a sucrose-based media augmented with vitamins (80% MS+Vit, 1% sucrose, 0.65% PhytoBlend™ Agar; Caisson Laboratories, Inc., North Logan, Utah) and appropriate kanamycin or sulfonamide concentrations where selection is required. Seeds are stratified in the dark on plates, at 4° C. for 3 days then moved to a walk-in growth chamber (Conviron MTW120, Conviron Controlled Environments Ltd, Winnipeg, Manitoba, Canada) running at a 10 hour photoperiod at a photosynthetic photon flux of approximately 200 μmol m$^{-2}$ s$^{-1}$ at plant height and a photoperiod/night temperature regime of 22° C./19° C. After seven days of light exposure seedlings are transplanted into 164 ml volume pots containing autoclaved ProMix® soil. All pots are returned to the same growth-chamber where they are stood in water and covered with a lid for the first seven days. This protocol keeps the soil moist during this period. Seven days after transplanting lids are removed and a watering and nutrition regime begun. All plants receive water three times a week, and a weekly a fertilizer treatment (80% Peter's NPK fertilizer).

Primary Screening.

Between 35 and 38 days after being transferred to lighted conditions on plates, and after between 28 and 31 days growth in soil, a suite of leaf-physiological parameters are measured using an infrared gas analyzer (LI-6400XT, LI-COR® Biosciences, Lincoln, NB, USA) integrated with a fluorimeter that measures fluorescence from Chlorophyll A (LI-6400-40, LI-COR Biosciences). This technique involves clamping a leaf between two gaskets, effectively sealing it inside a chamber, then measuring the exchange of carbon dioxide and water vapor between the leaf and the air flowing through the chamber. This gas exchange is monitored simultaneously with the fluorescence levels from the chlorophyll a molecules in the leaf. The growth conditions used, and plant age and leaf selection criteria for measurement are designed to maximize the chance that the leaves sampled fill the 2 cm$^2$ leaf chamber of the gas-exchange system and that plants show no visible signs of having transitioned to reproductive growth.

Screening High-Light Leaf Physiology at Two Air Temperatures.

Leaf physiology is screened after plants have been acclimated to high light (700 μmol photons m$^{-2}$ s$^{-1}$) under LED light banks emitting visible light (400-700 nm, Photon Systems Instruments, Brno, Czech Republic), for 40 minutes. Other than the change in light level, the atmospheric environment is the same as that in which the plants have been grown, and the LI-6400 leaf chamber is set to reflect this, being set to deliver a photosynthetic photon flux of 700 μmol photons m$^{-2}$ s$^{-1}$ and operate at an air temperature of 22° C. Forty minutes acclimation to a photosynthetic photon flux of 700 μmol photons m$^{-2}$ s$^{-1}$ has repeatedly been shown to be sufficient to achieve a steady-state rate of light-saturated photosynthesis and stomatal conductance in control plants. Gas exchange and fluorescence data are logged simultaneously two minutes after the leaf has been closed in the chamber. Two minutes is found to be long enough for the leaf chamber $CO_2$ and $H_2O$ concentrations to stabilize after closing a new leaf inside, and thereby minimizing leaf physiological adjustment to small differences between the growth environment and the LI-6400 chamber. Screening at the growth air temperature of 22° C. is begun one hour into the photoperiod and is typically completed in two hours. After being screened at 22° C., plants are returned to growth-light levels prior to being screened again at 35° C. later in the photoperiod. The higher-temperature screening begins six hours into the photoperiod and measurements are made after the rosettes have been acclimated to the same high light dose as described above, but this time in a controlled environment with an air temperature set to 35° C. Measurements are again made in a leaf chamber set to match the warmer air temperature and logged using the protocol described above for the 22° C. measurements. Data generated at both 22° C. and 35° C. are used to calculate: rates of $CO_2$ assimilation by photosynthesis (A, $\mu mol\ CO_2\ m^{-2}\ s^{-1}$); rates of $H_2O$ loss through transpiration (Tr, $mmol\ H_2O\ m^{-2}\ s^{-1}$); the conductance to $CO_2$ and $H_2O$ movement between the leaf and air through the stomatal pore ($g_s$, $mol.\ H_2O\ m^{-2}\ s^{-1}$); the sub-stomatal $CO_2$ concentration ($C_i$, $\mu mol\ CO_2\ mol^{-1}$); transpiration efficiency, the instantaneous ratio of photosynthesis to transpiration, (TE=A/Tr ($\mu mol\ CO_2\ mmol\ H_2O\ m^{-2}\ s^{-1}$)); the rate of electron flow through photosystem two (ETR $\mu mol\ e\text{-}m^{-2}\ s^{-1}$). Derivation of the parameters described above followed established published protocols (Long & Bernacchi, 2003. *J. Exp. Botany;* 54:2393-24)

Leaves from up to 10 replicate plants are screened for a given line of interest. Data generated from these lines are compared with that from an empty vector control line planted at the same time, grown within the same flats, and screened at the same time.

For control lines, data are collected not only at an atmospheric $CO_2$ concentration of 400 $\mu mol\ CO_2\ mol^1$, but also after stepwise changes in $CO_2$ concentration to 350, 300, 450 and 500 $\mu mol\ CO_2\ mol^{-1}$. These measurements underlay screening for more complex physiological traits of: (1) photosynthetic capacity; (2) Non-photochemical quenching; and (3) non-photosynthetic metabolism.

Screening Photosynthetic Capacity.

Under most conditions, the rate of light-saturated photosynthesis in a C3 leaf is a product of the biochemical capacity of the Calvin cycle and the transfer conductance of $CO_2$ concentration to the sites of carboxylation (Farquhar et al., 1980. *Planta:*149, 78-90). Plotting the rate of photosynthesis against an estimate of the sub-stomatal $CO_2$ concentration ($C_i$) provides a means to identify changes in photosynthetic capacity of the Calvin cycle independent of changes in stomatal conductance, a key component of the total transfer conductance to $CO_2$ of the leaf. Consequently, for lines being screened, rates of photosynthesis are plotted against a regression plot of A vs. $C_i$ generated for the control lines over a range of atmospheric $CO_2$ concentration, as described above. This technique enables visual confirmation of changes in photosynthetic capacity in lines of interest.

Screening Non-Photochemical Quenching.

During acclimation to high light, the efficiency with which photosystem PSII operates will reach a steady state regulated largely by the feedback between non-photochemical quenching (NPQ) in the antenna and the metabolic demand for energy produced in the chloroplast (Genty et al., 1989. *Biochim. Biophys. Acta* 990:87-92; Baker et al., 2007. *Plant Cell Environ.* 30:1107-1125). This understanding is used in this screen to identify lines in which the limitation that non-photochemical quenching exerts on the efficiency with which photosystem II operates is decreased or increased. A decrease in non-photochemical quenching may be the consequence of a decrease in the capacity for NPQ. This would result in lower levels of non-photochemical quenching and a higher efficiency of photosynthesis over a range of light levels, but importantly, higher rates of photosynthesis at low light where light-use efficiency is important. However, changes in rate at which NPQ responds to light could also underlie any increases or decreases in NPQ. Of these, an increase in the rate at which NPQ relaxes has the potential to increase rates of photosynthesis as leaves in crop canopies transition from high to low light, and is therefore relevant to increasing crop-canopy photosynthesis (Zhu et al., 2010. *Plant Biol.* 61:235-261). In keeping with the A/Ci analysis described above, a regression of the operating efficiency of PSII against non-photochemical quenching is generated for the control line from data collected over a range of atmospheric $CO_2$ concentration. This technique enables visual confirmation of changes in the regulation of PSII operation that are driven by changes in non-photochemical quenching in lines of interest.

Screening for Non-Photosynthetic Metabolism.

Measurement of the ratio of the rate of electron flow through PSII (ETR) to the rate of photosynthesis (A) is used to screen for changes in non-photosynthetic metabolism. This screen is based upon the understanding that the transport of four $\mu mol$ of electrons from PSII to photosystem one PSI will supply the NADPH and ATP required to fix one $\mu mol$ of $CO_2$ in the Calvin cycle. For a C3 leaf operating in an atmosphere with 21% oxygen, the ratio of electron flow to photosynthesis should be higher than four, reflecting photorespiratory and other metabolism. However, because the rate of photorespiration in a C3 leaf is dependent upon the concentration of $CO_2$ at the active site of Rubisco, a regression of the ratio of electron flow to photosynthesis, generated over the range of $CO_2$ concentrations described above, provides the reference regression against which lines being screened can be compared to controls. Changes in the ratio of ETR to A, when observed at the same $C_i$ as the control line, could indicate changes in the specificity of the Rubisco active site for $O_2$ relative to $CO_2$ and or other metabolic sinks which would be expected to have important implications for crop productivity and/or stress tolerance.

Surrogate Screening for Growth-Light Physiology.

Rosette biomass: the dry weight of whole *Arabidopsis* rosettes (i.e., above-ground biomass) is measured after being dried down at 80° C. for 24 hours, a time found to be sufficient to reach constant weight. Samples are taken after 35-38 days growth, and used as an assay of above-ground productivity at growth light. Typically, five replicate rosettes are sampled per *Arabidopsis* line being screened.

Rosette chemical and isotopic C and N analysis: after weighing, the five rosettes sampled for each line screened are pooled together and ground to a fine powder. The pooled sample generated is sub-sampled and approximately 4 $\mu g$ samples are prepared for analysis.

Chlorophyll content index (CCI): measurements of light transmission through the leaf are made for plants being screened using a chlorophyll content meter (CCM-200, Apogee Instruments, Logan, Utah, USA). The first is made within the first hour of the photoperiod prior to any acclimation to high light on leaves of plants samples for rosette analysis. The second is made later in the photoperiod on leaves of plants that had undergone the high-temperature screening.

Light absorption: measurements of CCI are used as a surrogate for leaf light absorption, based upon a known relationship between the two. The estimates of light absorption by the leaf, required to construct this relationship, were made by placing the leaf on top of a quantum sensor (LI-190, LI-COR Biosciences) with both the leaf and quantum sensor then pressed firmly up to the foam gasket underneath the LI-6400 light source. This procedure provides an estimate of the transmission of a known light flux through the leaf and is used to estimate the fraction of light absorbed by the leaf.

Example IV

Experimental Results

This Example provides experimental observations for transgenic plants overexpressing AtNAC6, WRKY17, AtNPR3, AtMYC1, AtMYB19, ERF058, CRF1, WRKY3, ZAT11, MYB111, SPATULA, or AtMYB50 related polypeptides in plate-based assays and results observed for improved photosynthetic resource use efficiency.

AtMYB19

Photosynthetic rate was increased in six of nine independent lines screened at growth temperature (22° C.) and seven of nine lines for measurements made after acclimation to high temperature. For measurements made at air temperatures of 22° C. and 35° C.; photosynthesis was increased by 16% at 22° C. and 17% at 35° C., when averaged across the lines that displayed increased photosynthesis. This provided evidence that the increase in photosynthesis is conferred over a wide range of air temperatures observed in *Arabidopsis* plants overexpressing AtMYB19. Leaf and crop-canopy photosynthesis is known to be related to final crop yield and improving photosynthesis is widely considered to be a relevant pathway to increasing crop yield. In a C3 plant, photosynthesis at high-light can be limited by the biochemical capacity for photosynthesis, indicated as photosynthetic capacity in Tables 23 and 24, or the supply of $CO_2$ into the chloroplast, of which stomatal conductance, which regulates the transfer of $CO_2$ into the leaf through stoma, is a principle component. Both the capacity for photosynthesis and stomatal conductance were increased in *Arabidopsis* plants overexpressing AtMYB19 assayed at both temperatures. Photosynthetic capacity was increased in five lines at 22° C. and in three at 35° C. Focused secondary assays on select lines, enabled the biochemical limitations to photosynthesis that underlay photosynthetic capacity, to be investigated. For measurements made at 22° C., the biochemical basis for the increase in photosynthetic capacity was an increase in both the activity of Rubisco (FIG. 3) and the capacity to regenerate RuBP, a key substrate for photosynthesis (FIG. 4). Increases in both these parameters were observed in four lines. For measurements made at 35° C., three lines displayed an increase in the capacity to regenerate RuBP.

Stomatal conductance was increased by 32% at 22° C. and 37% at 35° C., when averaged across the AtMYB19 overexpression lines that displayed increased photosynthesis. The extent to which photosynthesis is increased as a consequence of improvements in photosynthetic capacity and stomatal conductance has important implications. For example, increasing stomatal conductance will increase the supply of $CO_2$ into the leaf, however this will increase photosynthesis to a greater extent in a C3 plant than a C4 plant, where chloroplast $CO_2$ concentrations are typically maintained at close to saturating levels for photosynthesis. Increasing stomatal conductance will increase transpiration from the leaf, typically to a greater extent than photosynthesis is stimulated. This combination of traits may be more appropriate for crops growing on acreages where soil-water availability is seldom limiting yield. Conversely, an increase in photosynthetic capacity could increase photosynthetic rate without increasing stomatal conductance and water loss, and would be expected to increase crop yield over broad acres. For transgenic plants overexpressing AtMYB19 related polypeptides, the increase in photosynthetic rate was the result of increases in both photosynthetic capacity and stomatal conductance. Consequently transpiration efficiency, often used synonymously with WUE and expressed as unit carbon uptake via photosynthesis per unit water lost via transpiration, was typically not decreased across lines and temperatures.

All experimental observations of greater photosynthetic resource use efficiency were made by comparison to control plants (e.g., plants that did not comprise a recombinant construct encoding an AtMYB19-related polypeptide or overexpress an AtMYB19 clade or phylogenetically-related regulatory protein).

Tables 23 and 24 present the indicators of photosynthetic resource use efficiency observed in *Arabidopsis* plants overexpressing AtMYB19 in experiments conducted to date. The data presented in Table 23 were collected on plants at their normal growth temperature of 22° C. For lines with increased photosynthetic capacity, RuBP indicates that the capacity to increase RuBP was increased and Rubisco indicates that Rubisco activity was increased.

TABLE 23

Photosynthetic resource use efficiency measurements in plants with altered expression of AtMYB19 clade polypeptides at a growth temperature of 22° C.

| Polypeptide sequence/Line | SEQ ID NO | Driver | Target | Photosynthetic Rate 22° C. | Stomatal Conductance 22° C. | Photosynthetic Capacity |
|---|---|---|---|---|---|---|
| AtMYB19/Line 1 | 2 | 35S::m35S::oEnh:LexA:GAL4_opLexA::GFP | opLexA::G1309 | Increased (20%) | Increased (32%) | No effect |
| AtMYB19/Line 2 | 2 | 35S::m35S::oEnh:LexA:GAL4_opLexA::GFP | opLexA::G1309 | Increased (15%) | Increased (28%) | Increased (Rubisco and RuBP) |
| AtMYB19/Line 3 | 2 | 35S::m35S::oEnh:LexA:GAL4_opLexA::GFP | opLexA::G1309 | Increased (10%) | Increased (35%) | Increased (Rubisco and RuBP) |
| AtMYB19/Line 4 | 2 | 35S::m35S::oEnh:LexA:GAL4_opLexA::GFP | opLexA::G1309 | No effect | No effect | No effect |
| AtMYB19/Line 5 | 2 | 35S::m35S::oEnh:LexA:GAL4_opLexA::GFP | opLexA::G1309 | Increased (26%) | Increased (27%) | Increased |
| AtMYB19/Line 6 | 2 | 35S::m35S::oEnh:LexA:GAL4_opLexA::GFP | opLexA::G1309 | Increased (13%) | Increased (30%) | Increased RuBP |
| AtMYB19/Line 7 | 2 | 35S::m35S::oEnh:LexA:GAL4_opLexA::GFP | opLexA::G1309 | Increased (10%) | Increased (41%) | Increased RuBP |
| AtMYB19/Line 8 | 2 | 35S::m35S::oEnh:LexA:GAL4_opLexA::GFP | opLexA::G1309 | No effect | No effect | No effect |

The data presented in Table 24 were collected on plants acclimated to an air temperature of 35° C. For lines with increased photosynthetic capacity, RuBP indicates that the capacity to increase RuBP was increased and Rubisco indicates that Rubisco activity was increased.

TABLE 24

Photosynthetic resource use efficiency measurements in plants with altered expression of AtMYB19 clade polypeptides at a growth temperature of 35° C.

| Polypeptide sequence/Line | SEQ ID NO | Driver | Target | Photosynthetic Rate 22° C. | Stomatal Conductance 22° C. | Photosynthetic Capacity |
|---|---|---|---|---|---|---|
| AtMYB19/Line 1 | 2 | 35S::m35S::oEnh:LexA:GAL4_opLexA::GFP | opLexA::G1309 | Increased (22%) | Increased (49%) | No effect |
| AtMYB19/Line 2 | 2 | 35S::m35S::oEnh:LexA:GAL4_opLexA::GFP | opLexA::G1309 | Increased (14%) | Increased (43%) | Increased (RuBP) |
| AtMYB19/Line 3 | 2 | 35S::m35S::oEnh:LexA:GAL4_opLexA::GFP | opLexA::G1309 | Increased (15%) | Increased (23%) | Increased (RuBP) |
| AtMYB19/Line 4 | 2 | 35S::m35S::oEnh:LexA:GAL4_opLexA::GFP | opLexA::G1309 | Increased (26%) | Increased (39%) | No effect |
| AtMYB19/Line 5 | 2 | 35S::m35S::oEnh:LexA:GAL4_opLexA::GFP | opLexA::G1309 | Increased (22%) | Increased (37%) | No effect |
| AtMYB19/Line 6 | 2 | 35S::m35S::oEnh:LexA:GAL4_opLexA::GFP | opLexA::G1309 | Increased (19%) | Increased (61%) | No effect |
| AtMYB19/Line 7 | 2 | 35S::m35S::oEnh:LexA:GAL4_opLexA::GFP | opLexA::G1309 | Increased (13%) | Increased (28%) | Increased (RuBP) |
| AtMYB19/Line 8 | 2 | 35S::m35S::oEnh:LexA:GAL4_opLexA::GFP | opLexA::G1309 | No effect | Increased (17%) | No effect |

The results presented in Tables 23 and 24 were determined after screening nine independent transgenic events. Multiple lines were screened in replicate independent experiments.

AtMYB50

Table 25 lists the indicators of photosynthetic resource use efficiency observed in *Arabidopsis* plants overexpressing AtMYB50 in experiments conducted to date. Each of the lines overexpressing AtMYB50 (G1319) were generated by supertransforming a 35S::m35S::oEnh:LexA:GAL4_opLexA::GFP driver line with an opLexA::G1319 construct. Photosynthetic rate was increased by 24% for measurements made at an air temperature of 22° C. and averaged across six independent lines. Leaf and crop-canopy photosynthesis is known to be related to final crop yield, and improving photosynthesis is widely considered to be a relevant pathway to increasing crop yield. In a C3 plant, photosynthesis at high light can be limited by the biochemical capacity for photosynthesis, defined as photosynthetic capacity in Table 25, or the supply of $CO_2$ into the chloroplast, of which stomatal conductance, which regulates the transfer of $CO_2$ into the leaf through stoma, is a principal component. The extent to which photosynthesis is increased as a consequence of improvements in photosynthetic capacity and stomatal conductance has important implications. For example, increasing stomatal conductance will increase the supply of $CO_2$ into the leaf, however this will increase photosynthesis to a greater extent in a C3 plant than a C4 plant, where chloroplast $CO_2$ concentrations are typically maintained at close to saturating levels for photosynthesis. Increasing stomatal conductance will increase transpiration from the leaf, typically to a greater extent than photosynthesis is stimulated. This combination of traits may be more appropriate for crops growing on acreages where soil-water availability seldom limits yield. Conversely, an increase in photosynthetic capacity could increase photosynthetic rate without increasing stomatal conductance and water loss, and would be expected to increase crop yield over broad acres. For transgenic plants overexpressing AtMYB50 related polypeptides, the increase in photosynthetic rate was the result of increases in both photosynthetic capacity and stomatal conductance. Consequently transpiration efficiency, often used synonymously with WUE and expressed as unit carbon uptake via photosynthesis per unit water lost via transpiration, was not decreased across lines.

The dry weight of the rosette (that is, the above-ground biomass) was also increased in plants overexpressing AtMYB50. This measurement provides an estimate of productivity or net cumulative photosynthesis for these plants attained under growth conditions, not after acclimation to high light as described above. Increased rosette biomass could be the cumulative consequence of earlier seed germination, increases in the relative growth rate of the plant or improvements in underlying leaf physiology. Because increased rosette dry weight was achieved with the same availability of key resources of nitrogen and water as control plants, photosynthetic resource-use efficiency was increased under growth conditions. Regardless of the cause of the increase in productivity, this trait would be highly desirable in crops where the aboveground part of the plant is harvested. Crops farmed for seed yield could also benefit from faster canopy development that could result from earlier germination or increased relative growth rates.

All experimental observations of greater photosynthetic resource use efficiency were made by comparison to control plants (e.g., plants that did not comprise a recombinant construct encoding an AtMYB50-related polypeptide or overexpress an AtMYB50 clade or phylogenetically-related regulatory protein). Where a numerical value was determined, the percentage increases (+%) or decreases (−%) relative to control plants are shown in parentheses.

TABLE 25

Photosynthetic resource use efficiency measurements in plants
with altered expression of AtMYB50 clade polypeptides

| Polypeptide Sequence/Line | SEQ ID NO: | Photosynthetic Rate | Photosynthetic Capacity | Stomatal Conductance | Above-ground Biomass |
| --- | --- | --- | --- | --- | --- |
| AtMYB50/Line 1 | 135 | Increased (+32%) | Increased | Increased (+68%) | ** (0%) |
| AtMYB50/Line 2 | 135 | Increased (+23%) | | ** (+27%) | Increased (+32%) |
| AtMYB50/Line 3 | 135 | Increased (+22%) | Increased | ** (0) | Increased (+50%) |
| AtMYB50/Line 4 | 135 | Increased (+19%) | Increased | Increased (+25%) | Increased (+70%) |
| AtMYB50/Line 5 | 135 | ** (+15%) | | ** (+13%) | Increased (+23%) |
| AtMYB50/Line 6 | 135 | Increased (+32%) | Increased | Increased (+35%) | Increased (+23%) |

** measurement was not statistically significant relative to controls

The results presented in Table 25 were determined after screening six independent transgenic events and the observed increase in photosynthesis in five lines. These data were confirmed in two lines that received two passes through the screen.

CRF1

Table 26 lists the indicators of photosynthetic resource use efficiency observed in *Arabidopsis* plants overexpressing CRF1 in experiments conducted to date. Each of the lines overexpressing CRF1 (AT4G11140.1) were generated by supertransforming a 35S::m35S::oEnh:LexA:GAL4_opLexA::GFP driver line with an opLexA::CRF1 construct.

Table 26 and FIG. 9 provide data detailing how discrimination against $^{13}C$ relative to $^{12}C$ during photosynthesis, and integrated over the life of the rosette, was decreased in lines overexpressing CRF1 relative to control lines. The result of decreased discrimination against $^{13}C$ is that the $\delta^{13}C$ signature of the rosette increased by between 1.3 and 2.2 per mill (‰) when expressed using standard notation described in Farquhar et. al., 1989, supra ($\delta^{13}C$ is a measure of the ratio of isotopes $^{13}C:^{12}C$, relative to the same ratio in a reference and reported herein in parts per thousand (per mil or ‰)). These data are consistent with an increase in WUE, integrated over the life of the rosette in the CRF1 overexpression lines. All experimental observations of greater photosynthetic resource use efficiency were made by comparison to control plants (e.g., plants that did not comprise a recombinant construct encoding an CRF1-related polypeptide or overexpress an CRF1 clade or phylogenetically-related regulatory protein).

TABLE 26

Photosynthetic resource use efficiency measurements in plants
with altered expression of CRF1 clade polypeptides

| Polypeptide Sequence/Line | SEQ ID NO: | Rosette $\delta^{13}C$ (per mil) |
| --- | --- | --- |
| CRF1/Line 1 | 307 | Increased (1.4‰) |
| CRF1/Line 2 | 307 | Increased (1.6‰) |
| CRF1/Line 3 | 307 | Increased (1.5‰) |
| CRF1/Line 4 | 307 | Increased (2.2‰) |
| CRF1/Line 5 | 307 | Increased (1.7‰) |

The results presented in Table 26 were determined after screening five independent transgenic events. These data were confirmed for the three lines that received two passes through the screen.

ERF058

Table 27 lists the indicators of photosynthetic resource use efficiency observed in *Arabidopsis* plants overexpressing ERF058 in experiments conducted to date. Each of the lines overexpressing ERF058 (G974) was generated by supertransforming a 35S::m35S::oEnh:LexA:GAL4_opLexA::GFP driver line with an opLexA::ERF058 construct.

Table 27 and FIG. 12 provide data detailing how discrimination against $^{13}C$ relative to $^{12}C$ during photosynthesis, and integrated over the life of the rosette, was decreased in lines overexpressing ERF058 relative to control lines. The result of decreased discrimination against $^{13}C$ is that the $\delta^{13}C$ signature of the rosette increased by between 1.8 and 3.6 per mill (‰) when expressed using standard notation described in Farquhar et. al. 1989, supra ($\delta^{13}C$ is a measure of the ratio of isotopes $^{13}C:^{12}C$, relative to the same ratio in a reference and reported herein in parts per thousand (per mil or ‰)). These data are consistent with an increase in WUE integrated over the life of the rosette in the ERF058 overexpression lines. Transpiration efficiency, the ratio of photosynthesis to transpiration, of leaves of ERF058 overexpression lines was increased by between 32% and 101% under growth light conditions (Table 27). These data provide a link between improved WUE measured at a point in time at the leaf level and an integrated assessment at the whole rosette level. Further, WUE was likely increased because stomata conductance was lower in the ERF058 overexpression lines, by between 40% and 68% (Table 27). For measurements made at growth light, decreasing stomatal conductance will decrease transpiration but have little impact on photosynthesis as light, will limit the rate of photosynthesis more than $CO_2$ diffusion into the leaf. All experimental observations of greater photosynthetic resource use efficiency were made by comparison to control plants (e.g., plants that did not comprise a recombinant construct encoding an ERF058-related polypeptide or overexpress an ERF058 clade or phylogenetically-related regulatory protein). Where a numerical value was determined, the percentage increases (+%) or decreases (−%) relative to control plants are shown in parentheses.

TABLE 27

Photosynthetic resource use efficiency measurements in plants with altered expression of ERF058 clade polypeptides

| Polypeptide Sequence/Line | SEQ ID NO: | Rosette $\delta^{13}C$ (per mil) | Transpiration efficiency | Stomatal Conductance |
|---|---|---|---|---|
| ERF058/Line 1 | 490 | Increased (2.6‰) | Increased (101%) | Decreased (68%) |
| ERF058/Line 2 | 490 | Increased (2.3‰) | Not assayed | Not assayed |
| ERF058/Line 3 | 490 | Increased (3.6‰) | Increased (38%) | Decreased (47%) |
| ERF058/Line 4 | 490 | Increased (1.8‰) | Increased (32%) | Decreased (40%) |
| ERF058/Line 5 | 490 | No effect | No effect | No effect |

The results presented in Table 27 were determined after screening five independent transgenic events. For lines 1, 2 and 3, the rosette $\delta^{13}C$ data were confirmed in a repeat experiment and data presented are the mean of these two data sets.

SPATULA

This Example provides experimental observations for transgenic plants overexpressing SPATULA-related polypeptides in plate-based assays and results observed for improved photosynthetic resource use efficiency.

Arabidopsis plants constitutively overexpressing the SPATULA protein were early flowering and exhibited a number of leaf and rosette morphological changes. Under continuous light conditions, SPATULA overexpressor typically produced visible flower buds approximately one week earlier than wild type controls. At the time of bolting, these plants had 4-8 rosette leaves compared with 8-11 in wild type. Additionally, SPATULA overexpressors had pointed leaves at early stages of development, appeared slightly small, yellow, and at a later stage had elongated leaf petioles. Other than these effects, no obvious physiological or biochemical phenotypes were recorded. Gene expression profiling revealed that SPATULA was expressed at relatively higher levels in flowers, siliques and roots. However, SPATULA expression levels appeared unaffected by multiple assay conditions. The published literature describes SPATULA as a key control on flower development (Foreman et al. (2011) *Plant Signal. Behav.* 6:471-476, and regulator of both seed dormancy and cotyledon expansion based upon light quality signals and interaction with DELLA proteins (Josse et al. 2011. *Plant Cell* 23: 1337-1351). However, there appears nothing in the peer-reviewed literature that specifically addresses crop-relevant physiological consequences of changes in SPATULA expression in plants.

Leaf chlorophyll content was decreased by 32%, for measurements made on six independent SPATULA overexpression lines at an air temperature of 22° C., and also by 32% averaged across the same six lines after plant acclimation to 35° C. (Table 28). Set against this 32% decrease in leaf chlorophyll content, light-saturated photosynthesis was decreased by only 3% at 22° C., and increased by 4% at 35° C. (Table 28). Qualitative assessments of photosynthetic capacity made during the same screening runs revealed no systematic decreases in photosynthetic capacity across the six lines tested at either temperature (Table 28). While absorption of light energy is essential for photosynthesis, crop plants are thought to overinvest resources in chlorophyll and the light harvesting apparatus, and absorb more light energy than is required to meet the energetic demands of photosynthesis. This is thought to be an evolutionary consequence of improvements in fitness acquired from shading out rival plants. Physiological consequences of absorbing light in excess under stress conditions that constrain photosynthesis are well documented and can include; damage to the photosynthetic apparatus; decreased photosynthesis and in extreme plant death. However, even under optimal conditions for photosynthesis excess leaf chlorophyll can constrain leaf and canopy photosynthesis by decreasing transmission of light energy deeper into the canopy or leaf profile where photosynthesis is light-limited. The data provided in Table 28 provide evidence that the efficiency with which photosynthesis operates at high light in SPATULA overexpression lines can be increased with respect to the amount of light absorbed, an increase in photosynthetic light-use efficiency. This increase in photosynthetic light-use efficiency would be expected to increase leaf and canopy photosynthesis and crop yield: by decreasing the potential for photodamage of the photosynthetic apparatus; increasing light-limited photosynthesis by allowing transmission of more light into the light-limited layers of the leaf and crop canopy; and, making available nitrogen that had been overinvested in light harvesting.

Table 28 lists the indicators of photosynthetic resource use efficiency observed in *Arabidopsis* plants overexpressing SPATULA in experiments conducted to date. Each of the lines overexpressing SPATULA (G590 or AT4G36930) were generated by supertransforming a 35S::m35S::oEnh:LexA: GAL4_opLexA::GFP driver line with an opLexA::SPT construct.

All experimental observations of greater photosynthetic resource use efficiency were made by comparison to control plants (e.g., plants that did not comprise a recombinant construct encoding a SPATULA-related polypeptide or overexpress a SPATULA clade or phylogenetically-related regulatory protein). Where a numerical value was determined, the percentage increases (+%) or decreases (−%) relative to control plants are shown in parentheses.

TABLE 28

Photosynthetic resource use efficiency measurements in plants with altered expression of SPATULA clade polypeptides

| Polypeptide Sequence/Line | SEQ ID NO: | Air Temperature | Leaf Chlorophyll | Photosynthesis | Photosynthetic Capacity |
|---|---|---|---|---|---|
| SPATULA/Line 1 | 625 | 22 | Decreased (15%) | Increased (15%) | No effect |
| SPATULA/Line 2 | 625 | 22 | Decreased (40%) | Decreased 13% | Decreased |
| SPATULA/Line 3 | 625 | 22 | Decreased (31%) | Decreased (5%) | Variable effect |

TABLE 28-continued

Photosynthetic resource use efficiency measurements in plants
with altered expression of SPATULA clade polypeptides

| Polypeptide Sequence/Line | SEQ ID NO: | Air Temperature | Leaf Chlorophyll | Photosynthesis | Photosynthetic Capacity |
|---|---|---|---|---|---|
| SPATULA/Line 4 | 625 | 22 | Decreased (38%) | Increased (17%) | No effect |
| SPATULA/Line 5 | 625 | 22 | Decreased (33%) | Decreased (16%) | Variable effect |
| SPATULA/Line 6 | 625 | 22 | Decreased (37%) | Decreased (15%) | Decreased |
| SPATULA/Line 1 | 625 | 35 | Decreased (35%) | Increased (33%) | No effect |
| SPATULA/Line 2 | 625 | 35 | Decreased (39%) | Increased (19%) | No effect |
| SPATULA/Line 3 | 625 | 35 | Decreased (30%) | Decreased (17%) | No effect |
| SPATULA/Line 4 | 625 | 35 | Decreased (32%) | Increased (14%) | No effect |
| SPATULA/Line 5 | 625 | 35 | Decreased (30%) | Decreased (17%) | Variable |
| SPATULA/Line 6 | 625 | 35 | Decreased (26%) | Decreased (9%) | No effect |

The results presented in Table 28 were determined after screening six independent transgenic events at two air temperatures 22 and 35° C. Lines 3 and 5 were assayed twice in two independent experiments, in which the effects on chlorophyll content and photosynthesis were repeated. Data shown for these two lines is the mean of the effect size observed in those two experiments.

MYB111

Table 29 lists the indicators of photosynthetic resource use efficiency observed in *Arabidopsis* plants overexpressing MYB111 in experiments conducted to date. Each of the lines overexpressing MYB111 (AT5G49330 or G1640) were generated by supertransforming a 35S::m35S::oEnh:LexA: GAL4_opLexA::GFP driver line with an opLexA::MYB111 construct. The data in Table 29 detail a 26% decrease in stomatal conductance, a 20% decrease in $H_2O$ loss from the leaf through transpiration and a 12% increase in transpiration efficiency, the ratio of photosynthesis to transpiration, averaged across six independent MYB111 overexpression lines for measurements made at 35° C. Increases in instantaneous transpiration efficiency, the ratio of photosynthesis to transpiration, improve photosynthetic resource use efficiency and are expected to be relevant to increasing crop yield. For MYB111 overexpression lines, the magnitude of the decrease in stomatal conductance and transpiration rate were larger than the increase in transpiration efficiency. This was because the decrease in stomatal conductance also decreased photosynthetic rate. This would be expected for *Arabidopsis*, a plant with the C3 photosynthetic pathway. However, for crops operating a C4 photosynthetic pathway, stomatal conductance can be decreased without significant decreases in photosynthetic rate, a consequence of the chloroplast $CO_2$ concentrating mechanism that distinguishes C3 from C4 photosynthesis. Consequently, the same magnitude of decrease in stomatal conductance in both C3 and C4 crops would be expected to increase transpiration efficiency much more in the C4 crop. However, for both C3 and C4 crops decreasing stomatal conductance is considered a yield relevant trait, even if it compromises photosynthesis. This is because the long-term benefits of decreasing leaf transpiration could more than compensate for short-term decreases in photosynthesis in crops growing in a field setting. In a field setting, soil water will be conserved under canopies with decreased stomatal conductance during early development, thereby sustaining plant-water status and canopy photosynthesis during crucial periods later in the crops development when canopy photosynthesis would typically become limited by soil water availability, such as grain filling, and protect against the deleterious effects of absorbing light energy when photosynthesis is constrained. Consequently there is good reason to assume that decreasing stomatal conductance is a means to improve photosynthetic resource efficiency when integrated over the entire life of the crop.

All experimental observations of greater photosynthetic resource use efficiency were made by comparison to control plants (e.g., plants that did not comprise a recombinant construct encoding a MYB111-related polypeptide or overexpress a MYB111 clade or phylogenetically-related regulatory protein). Where a numerical value was determined, the percentage increases (+%) or decreases (−%) relative to control plants are shown in parentheses.

TABLE 29

Photosynthetic resource use efficiency measurements in plants
with altered expression of MYB111 clade polypeptides

| Polypeptide Sequence/Line | SEQ ID NO: | Stomatal Conductance | Transpiration rate | Transpiration efficiency |
|---|---|---|---|---|
| Myb111/Line 1 | 735 | Decreased (21%) | Decreased (15%) | Increased (17%) |
| Myb111/Line 2 | 735 | Decreased (25%) | Decreased (18%) | Increased (2%) |
| Myb111/Line 3 | 735 | Decreased (10%) | Decreased (8%) | Increased (4%) |
| Myb111/Line 4 | 735 | Decreased (41%) | Decreased (33%) | Increased (31%) |
| Myb111/Line 5 | 735 | Decreased (35%) | Decreased (25%) | Decreased (3%) |
| Myb111/Line 6 | 735 | Decreased (26%) | Decreased (20%)d | Increased (18%) |

The results presented in Table 29 were determined after screening six independent transgenic lines. Lines 1, 4 and 6 were assayed in two independent experiments, the direction of effect on all parameters in table 5 was repeated in both assays, and the data shown is the mean of the two data sets.

AtNPR3

FIG. 19 and Table 30 display and list, respectively, the indicators of photosynthetic resource use efficiency observed in *Arabidopsis* plants overexpressing AtNPR3 in experiments conducted to date. Each of the lines overexpressing AtNPR3 (AT5G45110.1 or G839) were generated by supertransforming a 35S::m35S::oEnh:LexA:GAL4_opLexA::GFP driver line with an opLexA::AtNPR3 construct.

This biochemical capacity for photosynthesis is a product of plant resource investment in numerous pigments and protein required to absorb light and couple it to the enzymatic reduction of carbon in the air to sugars, in the chloroplast. This capacity for photosynthesis sets limits upon the rate of photosynthesis that can be achieved by a leaf, and ultimately the yield potential of crops. Consequently, increasing photosynthetic capacity is considered a pathway to improving crop yield across broad acres. Of the numerous enzymes that limit photosynthesis, the activity of Rubisco is a key constraint in both C3 and C4 leaves. FIG. 19 displays data showing an increase in photosynthetic capacity in five independent AtNPR3 overexpression lines. The data were collected under low atmospheric $CO_2$ conditions, at which increased rates of light-saturated photosynthesis are routinely interpreted as evidence of increased Rubisco activity (Long & Bernacchi, 2003 supra). Data presented in Table 30 details up to a 15% increase in photosynthesis when averaged across five AtNPR3 overexpression lines and two independent experiments, for the lines in which Rubisco activity was increased. Averaged across all lines this increase in photosynthetic capacity and rate were achieved with a not statistically significant 3% decrease in leaf chlorophyll content, and a not statistically significant 0.03% increase in rosette nitrogen content, evidence of improved photosynthetic resource use efficiency.

All experimental observations of greater photosynthetic resource use efficiency were made by comparison to control plants (e.g., plants that did not comprise a recombinant construct encoding an AtNPR3-related polypeptide or overexpress an AtNPR3 clade or phylogenetically-related regulatory protein). Where a numerical value was determined, the percentage increases (+%) or decreases (−%) relative to control plants are shown in parentheses.

5 were assayed in two independent experiments; the direction of effect on photosynthetic capacity and photosynthesis was repeated in both assays, and the data shown is the mean of the two data sets.

AtMYC1

This biochemical capacity for photosynthesis is a product of plant resource investment in numerous pigments and protein required to absorb light and couple it to the enzymatic reduction of carbon in the air to sugars, in the chloroplast. This capacity for photosynthesis sets limits upon the rate of photosynthesis that can be achieved by a leaf, and ultimately the yield potential of crops. Consequently, increasing photosynthetic capacity is considered a pathway to improving crop yield across broad acres. Of the numerous enzymes that limit photosynthesis, the activity of Rubisco is a key constraint in both C3 and C4 leaves. FIG. 22 displays data showing an increase in photosynthetic capacity in four out of five independent overexpression lines. The data were collected under low atmospheric $CO_2$ conditions, at which increased rates of light-saturated photosynthesis are routinely interpreted as evidence of increased Rubisco activity (Long & Bernacchi 2003 already cited above). Data presented in table 5 records rates of photosynthesis measured at current atmospheric $[CO_2]$ for the same five lines, and details an 18% increase in photosynthesis when averaged across all five overexpression lines and two independent experiments. This increase can be attributed to the increase in Rubisco activity shown in figure three. Averaged across all lines this increase in photosynthetic capacity and rate were achieved with a smaller 3.5% increase in leaf chlorophyll content, and only 0.13%

TABLE 30

Photosynthesis and photosynthetic resource use efficiency related parameters measured in plants with altered expression of AtNPR3 clade polypeptides

| Polypeptide Sequence/Line | SEQ ID NO: | Photosynthetic Capacity | Photosynthetic Rate | Leaf Chlorophyll content | Rosette N content |
|---|---|---|---|---|---|
| AtNPR3/Line 1 | 864 | Increased | Increased (13%) | Increased (1%*) | No data |
| AtNPR3/Line 2 | 864 | Increased | Increased (15%) | Decreased (4%) | No data |
| AtNPR3/Line 3 | 864 | Increased | Increased (11%) | No effect | Increased (0.03%*) |
| AtNPR3/Line 4 | 864 | Increased | Increased (11%) | Decreased (8%) | Increased (0.09%*) |
| AtNPR3/Line 5 | 864 | Increased | Increased (15%) | Decreased (6%) | Decreased (0.03%*) |

*Denotes an effect that was not statistically significant at p < 0.1.

The results presented in Table 30 were determined after screening five independent transgenic lines. Lines 3, 4 and 5 increase in rosette nitrogen content, evidence of improved photosynthetic resource use efficiency.

TABLE 31

Photosynthesis and photosynthetic resource use efficiency related parameters measured in plants with altered expression of AtMYC1 clade polypeptides

| Polypeptide Sequence/Line | SEQ ID NO: | Photosynthetic Capacity | Photosynthetic Rate | Leaf Chlorophyll Content | Rosette N Content |
|---|---|---|---|---|---|
| AtMYC1/Line 1 | 1016 | Increased | Increased (13%) | Increased (9%) | No data |
| AtMYC1/Line 2 | 1016 | No effect | Increased (14%) | Decreased (4%) | Decreased (0.01%*) |
| AtMYC1/Line 3 | 1016 | Increased | Increased (28%) | Increased (1%) | Decreased (0.06%*) |

TABLE 31-continued

Photosynthesis and photosynthetic resource use efficiency related parameters
measured in plants with altered expression of AtMYC1 clade polypeptides

| Polypeptide Sequence/Line | SEQ ID NO: | Photosynthetic Capacity | Photosynthetic Rate | Leaf Chlorophyll Content | Rosette N Content |
|---|---|---|---|---|---|
| AtMYC1/Line 4 | 1016 | Increased | Increased (20%) | Increased (7%) | No data |
| AtMYC1/Line 5 | 1016 | Increased | Increased (17%) | Increased (4%) | Decreased (0.32%*) |

The results presented in Table 31 were determined after screening five independent transgenic lines. Lines 2, 3 and 5 were assayed in two independent experiments. For these lines the direction of effect on photosynthetic capacity and photosynthesis parameters was repeated in both assays for two of the three lines. For all three lines the data shown is the mean of two data sets.

All experimental observations of greater photosynthetic resource use efficiency were made by comparison to control plants (e.g., plants that did not comprise a recombinant construct encoding an AtMYC1-related polypeptide or overexpress an AtMYC1 clade or phylogenetically-related regulatory protein). Where a numerical value was determined, the percentage increases (+%) or decreases (-%) relative to control plants are shown in parentheses.

WRKY

Light-saturated photosynthesis was increased in WRKY3 overexpression lines, by 23% and 27% for measurements made at 22° C. and 35° C. respectively, and averaged over four independent lines (Table 32). The rate of photosynthesis is the product of the capacity for photosynthesis, and the supply of $CO_2$ into the leaf. The capacity for photosynthesis depends upon plant resource investment into the numerous pigments and proteins required to absorb light and couple it to the enzymatic reduction of carbon in the air to sugars, in the chloroplast. This capacity for photosynthesis sets limits upon the rate of photosynthesis that can be achieved by a leaf, and ultimately the yield potential of crops. FIG. 25 provides repeated evidence of an increase in photosynthetic capacity in two out of four independent WRKY3 overexpression lines for measurements made at the plants growth temperature, of 22° C. This evidence is displayed by increased rates of light-saturated photosynthesis when compared to the rate of photosynthesis predicted for control lines at the same leaf internal $CO_2$ concentration ($C_i$) (Long & Bernacchi 2003 already cited above). FIG. 27 provides evidence that the biochemical basis of this increase in photosynthetic capacity is an increase in the activity of Rubisco in the WRKY3 overexpression lines relative to the control lines, as evidenced by increased rates of light-saturated photosynthesis at low $C_i$ where Rubisco activity is the principle constraint on photosynthesis (also described in Long and Bernacchi 2003). This increase in Rubisco activity would be expected to underlie some component of the, over 30% increase in photosynthetic rate in these same lines, detailed in Table 32. FIG. 26 provides evidence that photosynthetic capacity has also been increased in the same two lines after acclimation to, and at, 35° C. Increasing the supply of $CO_2$ into the leaf, by increasing stomatal conductance to $CO_2$ transfer through the stomatal pore, will also increase photosynthesis. Stomatal conductance was significantly increased in each of the four WRKY3 overexpression lines at both temperatures, repeatedly in the two lines screened twice (Table 32). When averaged across all four lines, stomatal conductance was increased by 73% and 80% for measurements made at 22° C. and 35° C. respectively. This increase in stomatal conductance underlies the increase in photosynthesis in the two lines for which photosynthetic capacity was not increased and contributes to some component of the increase in photosynthetic rate in the two lines with increased photosynthetic capacity. While leaf nitrogen content was measured for three WRKY3 overexpression line only, the large significant increases in photosynthesis were achieved with no significant effects on leaf nitrogen content, evidence of improved photosynthetic resource use efficiency.

All experimental observations of greater photosynthetic resource use efficiency were made by comparison to control plants (e.g., plants that did not comprise a recombinant construct encoding a WRKY3-related polypeptide or overexpress a WRKY3 clade or phylogenetically-related regulatory protein). Where a numerical value was determined, the percentage increases (+%) or decreases (-%) relative to control plants are shown in parentheses.

TABLE 32

Photosynthesis and photosynthetic resource use efficiency related parameters
measured in plants with altered expression of WRKY3 clade polypeptides

| Polypeptide Sequence/Line | SEQ ID NO: | Temperature (° C.) | Photosynthetic Capacity | Photosynthetic Rate | Stomatal Conductance | Rosette N content |
|---|---|---|---|---|---|---|
| WRKY3/Line 1 | 1156 | 22 | No effect | Increased (10%) | Increased (47%) | Decreased (0.2%) |
| WRKY3/Line 2 | 1156 | 22 | Increased | Increased (32%) | Increased (94%) | Increased (0.5%) |
| WRKY3/Line 3 | 1156 | 22 | Increased | Increased (35%) | Increased (120%) | Increased (0.6%) |
| WRKY3/Line 4 | 1156 | 22 | No effect | Increased (14%) | Increased (32%) | No data |
| WRKY3/Line 1 | 1156 | 35 | No effect | Increased (17%) | Increased (57%) | — |
| WRKY3/Line 2 | 1156 | 35 | Increased | Increased (37%) | Increased (99%) | — |
| WRKY3/Line 3 | 1156 | 35 | Increased | Increased (39%) | Increased (121%) | — |
| WRKY3/Line 4 | 1156 | 35 | No effect | Increased (14%) | Increased (44%) | — |

The results presented in Table 32 were determined after screening four independent transgenic lines. Lines 2 and 3 were assayed in two independent experiments. For both these lines the direction of effect on all parameters measured was repeated in both experiments. For both repeated lines the data shown is the mean of two data sets. All increases in photosynthetic rate and stomatal conductance were statistically significant (p<0.05).

AtNAC6

The biochemical capacity for photosynthesis is a key determinant of the efficiency with which photosynthesis operates relative to resources required for plant growth. The biochemical capacity for photosynthesis is the product of plant resource investment in numerous pigments and proteins required to absorb light and couple it to the enzymatic reduction of carbon in the air to sugars, in the chloroplast. This capacity for photosynthesis sets limits upon the rate of photosynthesis that can be achieved by a leaf, and ultimately the yield potential of crops. Consequently, increasing photosynthetic capacity is considered a pathway to improving crop yield across broad acres. Table 33 describes an increased capacity for photosynthesis in three of four independent lines overexpressing AtNAC6. This increase was confirmed in secondary screening designed to provide insight into the biochemistry that underlies increased photosynthetic capacity. Of the numerous steps that can limit photosynthesis, the activity of Rubisco and the capacity to regenerate RuBP in the Calvin cycle are key constraints. For all three lines with increased photosynthetic capacity in the primary screen, secondary analysis identified increases in both the activity of Rubisco (FIG. 30) and the capacity to regenerate RuBP (FIG. 31) in AtNAC6 overexpression lines (Table 33; Long & Bernacchi 2003, supra, describe the basis for assaying Rubisco activity and RuBP regeneration capacity). When averaged across these four lines, the increase in photosynthesis averaged 21% (Table 33). These increases in photosynthetic capacity and photosynthesis were achieved on average with a small decrease in the nitrogen content of the rosette tissue, providing evidence of improved photosynthetic resource use efficiency.

All experimental observations of greater photosynthetic resource use efficiency were made by comparison to control plants (e.g., plants that did not comprise a recombinant construct encoding an-related polypeptide or overexpress an AtNAC6 clade or phylogenetically-related regulatory protein). Where a numerical value was determined, the percentage increases (+%) or decreases (−%) relative to control plants are shown in parentheses.

WRKY 17

The biochemical capacity for photosynthesis is a key determinant of the efficiency with which photosynthesis operates relative to resources required for plant growth. The biochemical capacity for photosynthesis is the product of plant resource investment in numerous pigments and proteins required to absorb light and couple it to the enzymatic reduction of carbon in the air to sugars, in the chloroplast. This capacity for photosynthesis sets limits upon the rate of photosynthesis that can be achieved by a leaf, and ultimately the yield potential of crops. Consequently, increasing photosynthetic capacity is considered a pathway to improving crop yield across broad acres.

Table 34 describes an increased capacity for photosynthesis in three of five independent lines overexpressing WRKY17; for lines with increased photosynthetic capacity, the underlying process that has been increased is identified as Rubisco activity (Rubisco), the capacity to regenerate RuBP (RuBP), or both. Increased capacity for photosynthesis was confirmed in secondary screening designed to provide insight into the biochemistry that underlay increased photosynthetic capacity. Of the numerous steps that can limit photosynthesis, the activity of Rubisco and the capacity to regenerate RuBP in the Calvin cycle are key constraints. For all three WRKY17 overexpression lines with increased photosynthetic capacity in the primary screen, secondary analysis identified increases in the activity of Rubisco (FIG. 34). For one of these lines, there was evidence that the capacity to regenerate RuBP was also higher (Table 34; Long & Bernacchi 2003, supra, who describe the basis for assaying Rubisco activity and RuBP regeneration capacity). When averaged across these five lines, the increase in photosynthesis averaged 17%, when average for the three lines with increased photosynthetic capacity, the increase in photosynthesis was 27%. These increases in photosynthetic capacity and photosynthesis were achieved on average with a small decrease in the nitrogen content of the rosette tissue (Table 34), providing evidence of improved photosynthetic resource-use efficiency.

All experimental observations of greater photosynthetic resource use efficiency were made by comparison to control

TABLE 33

Increased capacity for photosynthesis in plant lines overexpressing AtNAC6

| Polypeptide Sequence/Line | SEQ ID NO: | Driver | Target | Photosynthesis | Photosynthetic Capacity | Rosette [N] |
|---|---|---|---|---|---|---|
| AtNAC6/Line 1 | 1369 | 35S::m35S::oEnh:LexA:GAL4_opLexA::GFP | opLexA::AtNAC6 | Increased (27%) | Increased Rubisco and RuBP | Increased (0.3%) |
| AtNAC6/Line 2 | 1369 | 35S::m35S::oEnh:LexA:GAL4_opLexA::GFP | opLexA::AtNAC6 | Increased (16%) | No effect | Decreased (0.3%) |
| AtNAC6/Line 3 | 1369 | 35S::m35S::oEnh:LexA:GAL4_opLexA::GFP | opLexA::AtNAC6 | Increased (25%) | Increased Rubisco and RuBP | Decreased (0.9%) |
| AtNAC6/Line 4 | 1369 | 35S::m35S::oEnh:LexA:GAL4_opLexA::GFP | opLexA::AtNAC6 | Increased (19%) | Increased Rubisco and RuBP | No data |

The results presented in Table 33 were determined after screening four independent transgenic events. Lines 1 and 3 were screened twice. For both lines the direction of the effect on AtNAC6 overexpression was the same in both screening runs, and any effect size reported for a given parameter is the mean of the two screening runs.

plants (e.g., plants that did not comprise a recombinant construct encoding a WRKY17-related polypeptide or overexpress a WRKY17 clade or phylogenetically-related regulatory protein). Where a numerical value was determined, the percentage increases (+%) or decreases (−%) relative to control plants are shown in parentheses.

TABLE 34

Increased photosynthetic capacity drives increases in photosynthetic resource-use efficiency in plant lines overexpressing WRKY17.

| Polypeptide Sequence/Line | SEQ ID NO: | Driver | Target | Photosynthetic Capacity | Photosynthesis | Rosette [N] |
|---|---|---|---|---|---|---|
| WRKY17/Line 1 | 1507 | 35S::m35S::oEnh:LexA: GAL4_opLexA::GFP | opLexA:: WRKY17 | Increased Rubisco and RuBP | Increased (27%) | Decreased (2%) |
| WRKY17/Line 2 | 1507 | 35S::m35S::oEnh:LexA: GAL4_opLexA::GFP | opLexA:: WRKY17 | Increased Rubisco | Increased (24%) | Decreased (5%) |
| WRKY17/Line 3 | 1507 | 35S::m35S::oEnh:LexA: GAL4_opLexA::GFP | opLexA:: WRKY17 | Increased Rubisco | Increased (29%) | Decreased (6%) |
| WRKY17/Line 4* | 1507 | 35S::m35S::oEnh:LexA: GAL4_opLexA::GFP | opLexA:: WRKY17 | No effect | Increased (3%) | Decreased (3%) |
| WRKY17/Line 5 | 1507 | 35S::m35S::oEnh:LexA: GAL4_opLexA::GFP | opLexA:: WRKY17 | No effect | Increased (2%) | Decreased (2%) |

The results presented in Table 34 were determined after screening five independent transgenic events. Line 1 was screened three times, and lines 2, 3 and 5 were screened twice. For all lines the direction of the effects on WRKY17 overexpression on photosynthetic rates and photosynthetic capacity was repeated in each screening run. Line 4 was only screened once.

ZAT11

The biochemical capacity for photosynthesis is a key determinant of the efficiency with which photosynthesis operates relative to resources required for plant growth. The biochemical capacity for photosynthesis is the product of plant resource investment in numerous pigments and proteins required to absorb light and couple it to the enzymatic reduction of carbon in the air to sugars, in the chloroplast. This capacity for photosynthesis sets limits upon the rate of photosynthesis that can be achieved by a leaf, and ultimately the yield potential of crops. Consequently, increasing photosynthetic capacity is considered a pathway to improving crop yield across broad acres.

Table 35 describes an increased capacity for photosynthesis and increased photosynthetic rate in five independent lines overexpressing ZAT11. An increased capacity for photosynthesis was initially identified in three lines run through a primary screen (line 1, 2 and 3). This increase was confirmed in two of these three lines and two new lines (line 4 and 5), in a secondary screening that identified an increase in the activity of Rubisco as the biochemical basis for the increase in photosynthetic capacity by the method of Long and Bernacchi, 2003, supra (FIG. 37). When averaged across these five lines, the increase in photosynthetic rate averaged 16%. These increases in photosynthetic capacity and photosynthesis were achieved with a decrease in the nitrogen content of the rosette tissue in three of the four lines for which data were collected (Table 35), providing evidence of improved photosynthetic resource-use efficiency.

All experimental observations of greater photosynthetic resource use efficiency were made by comparison to control plants (e.g., plants that did not comprise a recombinant construct encoding a ZAT11-related polypeptide or overexpress a ZAT11 clade or phylogenetically-related regulatory protein). Where a numerical value was determined, the percentage increases (+%) or decreases (−%) relative to control plants are shown in parentheses.

TABLE 35

Increased photosynthetic capacity drives increases in photosynthetic resource-use efficiency in plant lines overexpressing ZAT11.

| Polypeptide Sequence/Line | SEQ ID NO: | Driver | Target | Photosynthetic Capacity | Photosynthesis | Rosette [N] |
|---|---|---|---|---|---|---|
| ZAT11/Line 1 | 1591 | 35S::m35S::oEnh:LexA: GAL4_opLexA: :GFP | opLexA:: ZAT11 | Increased Rubisco | Increased (21%) | Decreased (7%) |
| ZAT11/Line 2 | 1591 | 35S::m35S::oEnh:LexA: GAL4_opLexA::GFP | opLexA:: ZAT11 | Increased | Increased (12%) | Decreased (13%) |
| ZAT11/Line 3 | 1591 | 35S::m35S::oEnh:LexA: GAL4_opLexA::GFP | opLexA:: ZAT11 | Increased Rubisco | Increased (24%) | Decreased (9%) |
| ZAT11/Line 4* | 1591 | 35S::m35S::oEnh:LexA: GAL4_opLexA::GFP | opLexA:: ZAT11 | Increased Rubisco | Increased (5%) | Not measured |
| ZAT11/Line 5 | 1591 | 35S::m35S::oEnh:LexA: GAL4_opLexA::GFP | opLexA:: ZAT11 | Increased Rubisco | Increased (18%) | No effect |

The results presented in Table 35 were determined after screening five independent transgenic events. Line 1, 2 and 3 were screened twice with the percent difference values in Table 35 being the mean of the effect observed in both screening runs. Increased photosynthetic capacity was repeatedly observed for Line 1 and 3, but only once for line 2. Lines 4 and 5 were screened once.

The present disclosure thus describes how the transformation of plants, which may include monocots and/or dicots, with an AtNAC6, WRKY17, AtNPR3, AtMYC1, AtMYB19, ERF058, CRF1, WRKY3, ZAT11, MYB111, SPATULA, or AtMYB50 clade polypeptide can confer to the transformed plants greater photosynthetic resource use efficiency than the level of photosynthetic resource use efficiency exhibited by control plants. In one embodiment, expression of AtNAC6, WRKY17, AtNPR3, AtMYC1, AtMYB19, ERF058, CRF1, WRKY3, ZAT11, MYB111, SPATULA, or AtMYB50 is driven by a constitutive promoter. In another embodiment, expression of AtNAC6, WRKY17, AtNPR3, AtMYC1, AtMYB19, ERF058, CRF1, WRKY3, ZAT11, MYB111, SPATULA, or AtMYB50 is driven by a promoter with enhanced activity in a tissue capable of photosynthesis (also referred to herein as a "photosynthetic promoter" or a "photosynthetic tissue-enhanced promoter") such as a leaf tissue or other green tissue. Examples of photosynthetic tissue-enhanced promoters include for example, an RBCS3 promoter (SEQ ID NO: 1693), an RBCS4 promoter (SEQ ID NO: 1694) or others such as the At4g01060 (also referred to as "G682") promoter (SEQ ID NO: 1695), the latter regulating expression in guard cells, or promoters listed in Table 22. Other photosynthetic tissue-enhanced promoters have been taught by Bassett et al., 2007. *BMC Biotechnol.* 7: 47, specifically incorporated herein by reference in its entirety. Other photosynthetic tissue-enhanced promoters of interest include those from the maize aldolase gene FDA (U.S. patent publication no. 20040216189, specifically incorporated herein by reference in its entirety), and the aldolase and pyruvate orthophosphate dikinase (PPDK) (Taniguchi et al., 2000. *Plant Cell Physiol.* 41:42-48, specifically incorporated herein by reference in its entirety). Other tissue enhanced promoters or inducible promoters are also envisioned that may be used to regulate expression of AtNAC6, WRKY17, AtNPR3, AtMYC1, AtMYB19, ERF058, CRF1, WRKY3, ZAT11, MYB111, SPATULA, or AtMYB50 clade member polypeptides and improve photosynthetic resource use efficiency in a variety of plants.

Example V

Utilities of AtNAC6, WRKY17, AtNPR3, AtMYC1, AtMYB19, ERF058, CRF1, WRKY3, ZAT11, MYB111, SPATULA, or AtMYB50 Clade Sequences for Improving Photosynthetic Resource Use Efficiency, Yield or Biomass By expressing the present polynucleotide sequences in a commercially valuable plant, the plant's phenotype may be altered to one with improved traits related to photosynthetic resource use efficiency or yield. The sequences may be introduced into the commercially valuable plant, by, for example, introducing the polynucleotide in an expression vector or cassette to produce a transgenic plant, or by crossing a target plant with a second plant that comprises said polynucleotide. The transgenic or target plant may be any valuable species of interest, including but not limited to a crop or model plant such as a wheat, *Setaria*, corn (maize), rice, barley, rye, millet, sorghum, sugarcane, miscane, turfgrass, *Miscanthus*, switchgrass, soybean, cotton, rape, oilseed rape including canola, *Eucalyptus*, or poplar plant. The present polynucleotide sequences encode an AtNAC6, WRKY17, AtNPR3, AtMYC1, AtMYB19, ERF058, CRF1, WRKY3, ZAT11, MYB111, SPATULA, or AtMYB50 clade polypeptide sequence and the ectopic expression or overexpression in the transgenic or target plant of any of said polypeptides, for example, any of SEQ ID NOs: 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433; or 1507, 1509, 1511, 1513, 1515, 1517, 1519, 1521, 1523, 1525, 1527, 1529, 1531; or 864, 866, 868, 870, 872, 874, 876, 878, 880, 882, 884, 886, 888, 890, 892, 894, 896, 898, 900, 902, 904, 906, 908, 910, 912, 914, 916, 918, 920, 922; or 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072; or: 2, 4, 6, 8, 10, 12, 14, 16, 18, 20, 22, 24, 26, 28, 30, 32, 34; or 490, 492, 494, 496, 498, 500, 502, 504, 506, 508, 510, 512, 514, 516, 518, 520, 522, 524, 526, 528, 530, 532, 534, 536, 538, 540, 542, 544, 546, 548; or 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395; or 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226; or 1591, 1593, 1595, 1597, 1599, 1601, 1603, 1605, 1607, 1609, 1611, 1613, 1615, 1617; or 735, 737, 739, 741, 743, 745, 747, 749, 751, 753, 755, 757, 759, 761, 763, 765, 767, 769, 771, 773, 775, 777, 779, 781, 783; or 625, 627, 629, 631, 633, 635, 637, 639, 641, 643, 645, 647, 649, 651, 653, 655, 657, 659, 661, 663, 665; or 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, or 209, or a polypeptide comprising the consensus sequence AtNAC6, WRKY17, AtNPR3, AtMYC1, AtMYB19, ERF058, CRF1, WRKY3, ZAT11, MYB111, SPATULA, or AtMYB50 clade polypeptide comprises a consensus sequence of SEQ ID NO: 1467, 1468, 1469 of the AtNAC6 clade, SEQ ID NO: 1558, 1559, 1560, 1561 of the WRKY17 clade, SEQ ID NO: 981, 982, 983, 984, 985, 986 of the AtNPR3 clade, SEQ ID NO: 1153, 1154 of the AtMYC1 clade, SEQ ID NO: 129, 130, or 133 of the AtMYB19 clade, SEQ ID NO: 579, 580, 581 of the ERF058 clade, SEQ ID NO: 441, 442 of the CRF1 clade, SEQ ID NO: 1299, 1300 of the WRKY3 clade, SEQ ID NO: 1646, 1647, 1648, of the ZAT11 clade, SEQ ID NO: 834, 835, 836 of the MYB111 clade, SEQ ID NO: 687 of the SPATULA clade, or SEQ ID NO: 302, 303, 304, 305 of the AtMYB50 clade, can confer improved photosynthetic resource use efficiency or yield in the plant. For plants for which biomass is the product of interest, increasing the expression level of AtNAC6, WRKY17, AtNPR3, AtMYC1, AtMYB19, ERF058, CRF1, WRKY3, ZAT11, MYB111, SPATULA, or AtMYB50 clade of polypeptide sequences may increase yield, photosynthetic resource use efficiency, vigor, growth rate, and/or biomass of the plants. Thus, it is thus expected that these sequences will improve yield and/or photosynthetic resource use efficiency in non-*Arabidopsis* plants relative to control plants. This yield improvement may result in yield increases of at least 1%, 2%, 3%, 4%, 5%, 6%, 7%, 8%, 9%, 10%, 11%, 12%, 13%, 14%, 15%, 16%, 17%, 18%, 19%, 20%, 25%, 30% or greater yield relative to the yield that may be obtained with control plants.

It is expected that the same methods may be applied to identify other useful and valuable sequences that are functionally-related and/or closely-related to the listed sequences or domains provided in Tables 2 through 21, and the sequences may be derived from diverse species. Because of morphological, physiological and photosynthetic resource use efficiency similarities that may occur among AtNAC6, WRKY17, AtNPR3, AtMYC1, AtMYB19, ERF058, CRF1, WRKY3, ZAT11, MYB111, SPATULA, or AtMYB50-related sequences, the AtNAC6, WRKY17, AtNPR3, AtMYC1, AtMYB19, ERF058, CRF1, WRKY3, ZAT11, MYB111, SPATULA, or AtMYB50 clade sequences are expected to increase yield, plant growth, vigor, size, biomass, and/or increase photosynthetic resource use efficiency

Example VI

Expression and Analysis of Increased Yield or Photosynthetic Resource Use Efficiency in Non-*Arabidopsis* or Crop Species Northern blot analysis, RT-PCR or microarray analysis of the regenerated, transformed plants may be used to show expression of a polypeptide or the instant description and related genes that are capable of inducing improved photosynthetic resource use efficiency, and/or larger size.

After a eudicot plant, monocot plant or plant cell has been transformed (and the latter plant host cell regenerated into a plant) and shown to have greater photosynthetic resource use efficiency, and/or greater size, vigor, biomass, and/or produce greater yield relative to a control plant, the transformed monocot plant may be crossed with itself or a plant from the same line, a non-transformed or wild-type monocot plant, or another transformed monocot plant from a different transgenic line of plants.

The function of one or more specific polypeptides of the instant description has been analyzed and may be further characterized and incorporated into crop plants. The ectopic overexpression of one or more of AtNAC6, WRKY17, AtNPR3, AtMYC1, AtMYB19, ERF058, CRF1, WRKY3, ZAT11, MYB111, SPATULA, or AtMYB50 clade polypeptide sequences may be regulated using constitutive, inducible, or tissue-enhanced regulatory elements. Genes that have been examined have been shown to modify plant traits including increasing yield and/or photosynthetic resource use efficiency. It is expected that newly discovered polynucleotide and polypeptide sequences closely related, as determined by the disclosed hybridization or identity analyses, to polynucleotide and polypeptide sequences found in the Sequence Listing can also confer alteration of traits in a similar manner to the sequences found in the Sequence Listing, when transformed into any of a considerable variety of plants of different species, and including dicots and monocots. The polynucleotide and polypeptide sequences derived from monocots (e.g., the rice sequences) may be used to transform both monocot and dicot plants, and those derived from dicots (e.g., the *Arabidopsis* and soy genes) may be used to transform either group, although it is expected that some of these sequences will function best if the gene is transformed into a plant from the same group as that from which the sequence is derived.

As an example of a first step to determine photosynthetic resource use efficiency, seeds of these transgenic plants may be grown as described above or methods known in the art.

Closely-related homologs of AtNAC6, WRKY17, AtNPR3, AtMYC1, AtMYB19, ERF058, CRF1, WRKY3, ZAT11, MYB111, SPATULA, or AtMYB50 derived from various diverse plant species may be overexpressed in plants and have the same functions of conferring increased photosynthetic resource use efficiency. It is thus expected that structurally similar orthologs of the AtNAC6, WRKY17, AtNPR3, AtMYC1, AtMYB19, ERF058, CRF1, WRKY3, ZAT11, MYB111, SPATULA, or AtMYB50 polypeptide clade, including SEQ ID NO: 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433; or 1507, 1509, 1511, 1513, 1515, 1517, 1519, 1521, 1523, 1525, 1527, 1529, 1531; or 864, 866, 868, 870, 872, 874, 876, 878, 880, 882, 884, 886, 888, 890, 892, 894, 896, 898, 900, 902, 904, 906, 908, 910, 912, 914, 916, 918, 920, 922; or 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072; or: 2, 4, 6, 8, 10, 12, 14, 16, 18, 20, 22, 24, 26, 28, 30, 32, 34; or 490, 492, 494, 496, 498, 500, 502, 504, 506, 508, 510, 512, 514, 516, 518, 520, 522, 524, 526, 528, 530, 532, 534, 536, 538, 540, 542, 544, 546, 548; or 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395; or 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226; or 1591, 1593, 1595, 1597, 1599, 1601, 1603, 1605, 1607, 1609, 1611, 1613, 1615, 1617; or 735, 737, 739, 741, 743, 745, 747, 749, 751, 753, 755, 757, 759, 761, 763, 765, 767, 769, 771, 773, 775, 777, 779, 781, 783; or 625, 627, 629, 631, 633, 635, 637, 639, 641, 643, 645, 647, 649, 651, 653, 655, 657, 659, 661, 663, 665; or 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, or 209 can confer increased yield, and/or increased vigor, biomass, or size, relative to control plants. As at least one sequence of the instant description has increased photosynthetic resource use efficiency in *Arabidopsis*, it is expected that the sequences provided in the Sequence Listing, or polypeptide sequences comprising one of or any of the conserved domains provided in Tables 2 21, will increase the photosynthetic resource use efficiency and/or yield of transgenic plants including transgenic non-A rabidopsis (plant species other than *Arabidopsis* species) crop or other commercially important plant species, including, but not limited to, non-*Arabidopsis* plants and plant species such as monocots and dicots, wheat, *Setaria*, corn (maize), teosinte (*Zea* species which is related to maize), rice, barley, rye, millet, sorghum, sugarcane, miscane, turfgrass, *Miscanthus*, switchgrass, soybean, cotton, rape, oilseed rape including canola, tobacco, tomato, tomatillo, potato, sunflower, alfalfa, clover, banana, blackberry, blueberry, strawberry, raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, watermelon, rosaceous fruits including apple, peach, pear, cherry and plum, and brassicas including broccoli, cabbage, cauliflower, Brussels sprouts, and kohlrabi, currant, avocado, citrus fruits including oranges, lemons, grapefruit and tangerines, artichoke, cherries, endive, leek, roots such as arrowroot, beet, cassava, turnip, radish, yam, and sweet potato, beans, woody species including pine, poplar, *Eucalyptus*, mint or other labiates, nuts such as walnut and peanut. Within each of these species the Closely-related homologs of AtNAC6, WRKY17, AtNPR3, AtMYC1, AtMYB19, ERF058, CRF1, WRKY3, ZAT11, MYB111, SPATULA, or AtMYB50 may be overexpressed or ectopically expressed in different varieties, cultivars, or germplasm.

The instantly disclosed transgenic plants comprising the disclosed recombinant polynucleotides can be enhanced with other polynucleotides, resulting in a plant or plants with "stacked" or jointly introduced traits, for example, the traits of increased photosynthetic resource use efficiency and improved yield combined with an enhanced trait resulting from expression of a polynucleotide that confers herbicide, insect or and/or pest resistance in a single plant or in two or more parental lines. The disclosed polynucleotides may thus be stacked with a nucleic acid sequence providing other useful or valuable traits such as a nucleic acid sequence from *Bacillus thuringensis* that confers resistance to hemiopteran, homopteran, lepidopteran, coliopteran or other insects or pests.

Thus, the disclosed sequences and closely related, functionally related sequences may be identified that, when ectopically expressed or overexpressed in plants, confer one or more characteristics that lead to greater photosynthetic resource use efficiency. These characteristics include, but are not limited to, the embodiments listed below.

1. A dicot or monocot transgenic plant that has greater or increased photosynthetic resource use efficiency relative to a control plant;

wherein the transgenic plant comprises an exogenous recombinant polynucleotide comprising a constitutive promoter, a non-constitutive promoter, an inducible promoter, a tissue-enhanced promoter, or a photosynthetic tissue-enhanced promoter that regulates expression of a polypeptide having a percentage identity to an amino acid sequence comprising SEQ ID NO: 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433; or 1507, 1509, 1511, 1513, 1515, 1517, 1519, 1521, 1523, 1525, 1527, 1529, 1531; or 864, 866, 868, 870, 872, 874, 876, 878, 880, 882, 884, 886, 888, 890, 892, 894, 896, 898, 900, 902, 904, 906, 908, 910, 912, 914, 916, 918, 920, 922; or 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072; or: 2, 4, 6, 8, 10, 12, 14, 16, 18, 20, 22, 24, 26, 28, 30, 32, 34; or 490, 492, 494, 496, 498, 500, 502, 504, 506, 508, 510, 512, 514, 516, 518, 520, 522, 524, 526, 528, 530, 532, 534, 536, 538, 540, 542, 544, 546, 548; or 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395; or 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226; or 1591, 1593, 1595, 1597, 1599, 1601, 1603, 1605, 1607, 1609, 1611, 1613, 1615, 1617; or 735, 737, 739, 741, 743, 745, 747, 749, 751, 753, 755, 757, 759, 761, 763, 765, 767, 769, 771, 773, 775, 777, 779, 781, 783; or 625, 627, 629, 631, 633, 635, 637, 639, 641, 643, 645, 647, 649, 651, 653, 655, 657, 659, 661, 663, 665; or 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, or 209; and/or 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% identity to the entire length of any of SEQ ID NO: 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433; or 1507, 1509, 1511, 1513, 1515, 1517, 1519, 1521, 1523, 1525, 1527, 1529, 1531; or 864, 866, 868, 870, 872, 874, 876, 878, 880, 882, 884, 886, 888, 890, 892, 894, 896, 898, 900, 902, 904, 906, 908, 910, 912, 914, 916, 918, 920, 922; or 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072; or: 2, 4, 6, 8, 10, 12, 14, 16, 18, 20, 22, 24, 26, 28, 30, 32, 34; or 490, 492, 494, 496, 498, 500, 502, 504, 506, 508, 510, 512, 514, 516, 518, 520, 522, 524, 526, 528, 530, 532, 534, 536, 538, 540, 542, 544, 546, 548; or 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395; or 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226; or 1591, 1593, 1595, 1597, 1599, 1601, 1603, 1605, 1607, 1609, 1611, 1613, 1615, 1617; or 735, 737, 739, 741, 743, 745, 747, 749, 751, 753, 755, 757, 759, 761, 763, 765, 767, 769, 771, 773, 775, 777, 779, 781, 783; or 625, 627, 629, 631, 633, 635, 637, 639, 641, 643, 645, 647, 649, 651, 653, 655, 657, 659, 661, 663, 665; or 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, or 209 in a photosynthetic tissue to a level that is effective in conferring greater photosynthetic resource use efficiency in the transgenic plant relative to the control plant;

wherein the percentage identity is at least:

28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% identity to any of:

a NAM domain of SEQ ID NO:1434, 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465, 1466; or a Plant Zinc Cluster Domain of SEQ ID NO: 1507, 1532, 1533, 1534, 1535, 1536, 1537, 1538, 1539, 1540, 1541, 1542, 1543 1544; or a BTB domain of SEQ ID NO:864 or 923-950; or an ANK domain of SEQ ID NO 864, 951-980; or a Myb or Myb-like DNA binding domain of SEQ ID NO: 2; 61-77, 95-111, 135, 210-285; or a SANT domain of SEQ ID NO: 735-833; or a WRKY Domain of SEQ ID NO: 1156, 1227-1298; 1507, 1545-1557; or a Z-C2H2-1 domain of SEQ ID NO: 1591, 1618-1645; or an AP2 domain of SEQ ID NO: 307, 396-440; 489, 549-578; or a bHLH-MYC_N domain of SEQ ID NO: 1016 or 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129; and/or an HLH domain of 625, 666-686, 1016, 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130; and/or at least 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% identical to a consensus sequence of AtNAC6 clade sequences SEQ ID NO: 1467, 1468, 1469, WRKY17 clade sequences SEQ ID NO: 1558, 1559, 1560, 1561, AtNPR3 clade sequences SEQ ID NO: 981 to 986, AtMYC1 clade sequences SEQ ID NO: 1153, 1154, AtMYB19 clade consensus sequences SEQ ID NO: 129, 130, 131, 132, ERF058 clade consensus sequences SEQ ID NO: 579, 580, 581, CRF1 clade consensus sequences SEQ ID NO: 441, 442, WRKY3 clade consensus sequences SEQ ID NO: 1299, 1300, ZAT11 clade consensus sequences SEQ ID NO: 1646, 1647, 1648, MYB111 clade consensus sequences SEQ ID NO: 834, 835, 836, SPATULA clade consensus sequence SEQ ID NO: 687, or AtMYB50 clade consensus sequences SEQ ID NO: 302, 303, 304, 305;

wherein the control plant does not comprise the recombinant polynucleotide; and wherein expression of the polypeptide under the regulatory control of the promoter confers greater or increased photosynthetic resource use efficiency in the transgenic plant relative to the control plant; and/or 2. The transgenic plant of embodiment 1, wherein the photosynthetic tissue-enhanced promoter is an RBCS3 promoter, an RBCS4 promoter, an At4g01060 promoter, an Os02g09720 promoter, an Os05g34510 promoter, an Os11g08230 promoter, an Os01g64390 promoter, an Os06g15760 promoter, an Os12g37560 promoter, an Os03g17420 promoter, an Os04g51000 promoter, an Os01g01960 promoter, an Os05g04990 promoter, an Os02g44970 promoter, an Os01g25530 promoter, an Os03g30650 promoter, an Os01g64910 promoter, an Os07g26810 promoter, an Os07g26820 promoter, an Os09g11220 promoter, an Os04g21800 promoter, an Os10g23840 promoter, an Os08g13850 promoter, an Os12g42980 promoter, an Os03g29280 promoter, an Os03g20650 promoter, or an Os06g43920 promoter (SEQ ID NO: 1693-1719, respectively), or a functional variant thereof, or a functional fragment thereof, or a promoter sequence that is at least 80% identical to SEQ ID NO: 1693-1719; and/or 3. The transgenic plant of embodiments 1 or 2, wherein:

the recombinant polynucleotide encodes the polypeptide comprising SEQ ID NO: 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433; or 1507, 1509, 1511, 1513, 1515, 1517, 1519, 1521, 1523, 1525, 1527, 1529, 1531; or 864, 866, 868, 870, 872, 874, 876, 878, 880, 882, 884, 886, 888, 890, 892, 894, 896, 898, 900, 902, 904, 906, 908, 910, 912, 914, 916, 918, 920, 922; or 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072; or: 2, 4, 6, 8, 10, 12, 14, 16, 18, 20, 22, 24, 26, 28, 30, 32, 34; or 490, 492, 494, 496, 498, 500, 502, 504, 506, 508, 510, 512, 514, 516, 518, 520, 522, 524, 526, 528, 530, 532, 534, 536, 538, 540, 542, 544, 546, 548; or 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395; or 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226; or 1591, 1593, 1595, 1597, 1599, 1601, 1603, 1605, 1607, 1609, 1611, 1613, 1615, 1617; or 735, 737, 739, 741, 743, 745, 747, 749, 751, 753, 755, 757, 759, 761, 763, 765, 767, 769, 771, 773, 775, 777, 779, 781, 783; or 625, 627, 629, 631, 633, 635, 637, 639, 641, 643, 645, 647, 649, 651, 653, 655, 657, 659, 661, 663, 665; or 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, or 209, or the polypeptide is encoded by a second polynucleotide and expression of the polypeptide is regulated by a trans-regulatory element; and/or 4. The transgenic plant of any of embodiments 1 to 3, wherein, relative to the control plant, the transgenic plant has an altered trait that confers the greater photosynthetic resource use efficiency†; and/or 5. The transgenic plant of any of embodiments 1 to 4, wherein a plurality of the transgenic plants have greater cumulative canopy photosynthesis than the canopy photosynthesis of the same number of the control plants grown under the same conditions and at the same density; and/or 6. The transgenic plant of any of embodiments 1 to 5, wherein the transgenic plant produces a greater yield than the control plant, including, but not limited to a greater yield of vegetative biomass, plant parts, whole plants, shoot vegetative organs/structures (for example, leaves, stems and tubers), roots, flowers and floral organs/structures (for example, bracts, sepals, petals, stamens, carpels, anthers and ovules), seed (including embryo, endosperm, and seed coat) and fruit (the mature ovary), plant tissue (for example, vascular tissue, ground tissue, pulped, pureed, ground-up, macerated or broken-up tissue, and the like) and cells (for example, guard cells, egg cells, and the like); and/or 7. The transgenic plant of any of embodiments 1 to 6, wherein the transgenic plant is selected from the group consisting of a corn, wheat, rice, *Setaria, Miscanthus*, switchgrass, ryegrass, sugarcane, miscane, barley, sorghum, soy, cotton, canola, rapeseed, *Crambe, Camelina*, sugar beet, alfalfa, tomato, *Eucalyptus*, poplar, willow, pine, birch and a woody plant; and/or 8. The transgenic plant of any of embodiments 1 to 7, wherein the transgenic plant is morphologically similar at one or more stages of growth, and/or developmentally similar, to the control plant.

9. A method for increasing photosynthetic resource use efficiency in a dicot or monocot plant, the method comprising:

(a) providing one or more transgenic plants that comprise an exogenous recombinant polynucleotide that comprises a constitutive promoter, a non-constitutive promoter, an inducible promoter, a tissue-enhanced promoter, or a photosynthetic tissue-enhanced promoter that regulates a polypeptide comprising SEQ ID NO: 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433; or 1507, 1509, 1511, 1513, 1515, 1517, 1519, 1521, 1523, 1525, 1527, 1529, 1531; or 864, 866, 868, 870, 872, 874, 876, 878, 880, 882, 884, 886, 888, 890, 892, 894, 896, 898, 900, 902, 904, 906, 908, 910, 912, 914, 916, 918, 920, 922; or 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072; or: 2, 4, 6, 8, 10, 12, 14, 16, 18, 20, 22, 24, 26, 28, 30, 32, 34; or 490, 492, 494, 496, 498, 500, 502, 504, 506, 508, 510, 512, 514, 516, 518, 520, 522, 524, 526, 528, 530, 532, 534, 536, 538, 540, 542, 544, 546, 548; or 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395; or 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226; or 1591, 1593, 1595, 1597, 1599, 1601, 1603, 1605, 1607, 1609, 1611, 1613, 1615, 1617; or 735, 737, 739, 741, 743, 745, 747, 749, 751, 753, 755, 757, 759, 761, 763, 765, 767, 769, 771, 773, 775, 777, 779, 781, 783; or 625, 627, 629, 631, 633, 635, 637, 639, 641, 643, 645, 647, 649, 651, 653, 655, 657, 659, 661, 663, 665; or 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, or 209; and (b) growing the one or more transgenic plants; and wherein expression of the polypeptide in the one or more transgenic plants confers increased photosynthetic resource use efficiency relative to a control plant that does not comprise the recombinant polynucleotide; and/or 10. The method of embodiment 9, wherein the photosynthetic tissue-enhanced promoter is an RBCS3 promoter, an RBCS4 promoter, an At4g01060 promoter, an Os02g09720 promoter, an Os05g34510 promoter, an Os11g08230 promoter, an Os01g64390 promoter, an Os06g15760 promoter, an Os12g37560 promoter, an Os03g17420 promoter, an Os04g51000 promoter, an Os01g01960 promoter, an Os05g04990 promoter, an Os02g44970 promoter, an Os01g25530 promoter, an Os03g30650 promoter, an Os01g64910 promoter, an Os07g26810 promoter, an Os07g26820 promoter, an Os09g11220 promoter, an Os04g21800 promoter, an Os10g23840 promoter, an Os08g13850 promoter, an Os12g42980 promoter, an Os03g29280 promoter, an Os03g20650 promoter, or an Os06g43920 promoter (SEQ ID NO: 1693-1719, respectively), or a functional variant thereof, or a functional fragment thereof, or a promoter sequence that is at least 80% identical to SEQ ID NO: 1693-1719; and/or 11. The method of embodiments 9 or 10, wherein an expression cassette comprising the recombinant polynucleotide is introduced into a target plant to produce the transgenic plant; and/or 12. The method of any of embodiments 9 to 11, wherein the transgenic plant has an altered trait that confers the greater photosynthetic resource use efficiency†; and/or 13. The method of any of embodiments 9 to 12, wherein the transgenic plant is selected for having the increased photosynthetic resource use efficiency relative to the control plant; and/or 14. The method of any of embodiments 9 to 13, wherein the transgenic plant produces a greater yield relative to the control plant; and/or 15. The method of any of embodiments 9 to 14, wherein the plant is selected for having the greater yield relative to the control plant; and/or 16. The method of any of embodiments 9 to 15, wherein a plurality of the transgenic plants have greater cumulative canopy photosynthesis than the canopy photosynthesis of the same number of the control plants grown under the same conditions and at the same density; and/or 17. The method of any of embodiments 9 to 16, wherein the transgenic plant is selected from the group consisting of a corn, wheat, rice, *Setaria, Miscanthus*, switchgrass, ryegrass, sugarcane, miscane, barley, sorghum, soy, cotton, canola, rapeseed, *Crambe, Camelina*, sugar beet, alfalfa, tomato, *Eucalyptus*, poplar, willow, pine, birch and a woody plant; and/or 18. The method of any of embodiments 9 to 17, the method steps further including:

crossing the target plant with itself, a second plant from the same line as the target plant, a non-transgenic plant, a wild-type plant, or a transgenic plant from a different line of plants, to produce a transgenic seed.

19. A method for producing and selecting a dicot or monocot crop plant with greater yield or greater photosynthetic resource use efficiency than a control plant, the method comprising:

(a) providing one or more dicot or monocot transgenic plants that comprise an exogenous recombinant polynucleotide that comprises photosynthetic tissue-enhanced promoter that regulates a polypeptide comprising SEQ ID NO: 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433; or 1507, 1509, 1511, 1513, 1515, 1517, 1519, 1521, 1523, 1525, 1527, 1529, 1531; or 864, 866, 868, 870, 872, 874, 876, 878, 880, 882, 884, 886, 888, 890, 892, 894, 896, 898, 900, 902, 904, 906, 908, 910, 912, 914, 916, 918, 920, 922; or 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072; or: 2, 4, 6, 8, 10, 12, 14, 16, 18, 20, 22, 24, 26, 28, 30, 32, 34; or 490, 492, 494, 496, 498, 500, 502, 504, 506, 508, 510, 512, 514, 516, 518, 520, 522, 524, 526, 528, 530, 532, 534, 536, 538, 540, 542, 544, 546, 548; or 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395; or 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226; or 1591, 1593, 1595, 1597, 1599, 1601, 1603, 1605, 1607, 1609, 1611, 1613, 1615, 1617; or 735, 737, 739, 741, 743, 745, 747, 749, 751, 753, 755, 757, 759, 761, 763, 765, 767, 769, 771, 773, 775, 777, 779, 781, 783; or 625, 627, 629, 631, 633, 635, 637, 639, 641, 643, 645, 647, 649, 651, 653, 655, 657, 659, 661, 663, 665; or 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, or 209, wherein the photosynthetic tissue-enhanced promoter does not regulate protein expression in a constitutive manner;

(b) growing a plurality of the transgenic plants; and (c) selecting a transgenic plant that:

has greater photosynthetic resource use efficiency than the control plant, wherein the control plant does not comprise the recombinant polynucleotide; and/or comprises the recombinant polynucleotide;
wherein expression of the polypeptide in the selected transgenic plant confers the greater yield of the selected transgenic plant relative to the control plant; and/or 20. The method of embodiment 19, the method steps further including:
    (d) crossing the selected transgenic plant with itself, a second plant from the same line as the selected transgenic plant, a non-transgenic plant, a wild-type plant, or a transgenic plant from a different line of plants, to produce a transgenic seed; and/or 21. The method of embodiment 19 or 20, wherein the transgenic plant is selected for having the increased photosynthetic resource use efficiency relative to the control plant; and/or 22. The method of any of embodiments 19 to 21, wherein a plurality of the selected transgenic plants have greater cumulative canopy photosynthesis than the canopy photosynthesis of the same number of the control plants grown under the same conditions and at the same density; and/or 23. The method of any of embodiments 19 to 22, wherein the selected transgenic plant has an altered trait that confers the greater photosynthetic resource use efficiency†.

24. A method for producing a dicot or monocot crop plant with greater photosynthetic resource use efficiency than a control plant, the method comprising:
    (a) providing a dicot or monocot transgenic plant that comprises an exogenous recombinant polynucleotide that comprises a constitutive promoter, a non-constitutive promoter, an inducible promoter, a tissue-enhanced promoter, or a photosynthetic tissue-enhanced promoter that regulates expression of a polypeptide comprising SEQ ID NO: 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433; or 1507, 1509, 1511, 1513, 1515, 1517, 1519, 1521, 1523, 1525, 1527, 1529, 1531; or 864, 866, 868, 870, 872, 874, 876, 878, 880, 882, 884, 886, 888, 890, 892, 894, 896, 898, 900, 902, 904, 906, 908, 910, 912, 914, 916, 918, 920, 922; or 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072; or: 2, 4, 6, 8, 10, 12, 14, 16, 18, 20, 22, 24, 26, 28, 30, 32, 34; or 490, 492, 494, 496, 498, 500, 502, 504, 506, 508, 510, 512, 514, 516, 518, 520, 522, 524, 526, 528, 530, 532, 534, 536, 538, 540, 542, 544, 546, 548; or 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395; or 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226; or 1591, 1593, 1595, 1597, 1599, 1601, 1603, 1605, 1607, 1609, 1611, 1613, 1615, 1617; or 735, 737, 739, 741, 743, 745, 747, 749, 751, 753, 755, 757, 759, 761, 763, 765, 767, 769, 771, 773, 775, 777, 779, 781, 783; or 625, 627, 629, 631, 633, 635, 637, 639, 641, 643, 645, 647, 649, 651, 653, 655, 657, 659, 661, 663, 665; or 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, or 209 in a photosynthetic tissue of the transgenic plant to a level that is effective in conferring greater photosynthetic resource use efficiency in the transgenic plant relative to the control plant; and
    (b) measuring† an altered trait that confers the greater photosynthetic resource use efficiency,
    wherein expression of the polypeptide in the selected transgenic plant confers the greater photosynthetic resource use efficiency of the transgenic plant relative to the control plant, thereby producing the crop plant with greater photosynthetic resource use efficiency than the control plant; and/or 25. The method of embodiment 24, wherein the transgenic plant is selected for having the increased photosynthetic resource use efficiency relative to the control plant.

26. A method for producing a monocot plant with increased grain yield, said method including:
    (a) providing a monocot plant cell or plant tissue with stably integrated, exogenous, recombinant polynucleotide comprising a promoter (for example, a constitutive, a non-constitutive, an inducible, a tissue-enhanced, or a photosynthetic tissue-enhanced promoter) that is functional in plant cells and that is operably linked to an exogenous or an endogenous nucleic acid sequence that encodes SEQ ID NO: 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433; or 1507, 1509, 1511, 1513, 1515, 1517, 1519, 1521, 1523, 1525, 1527, 1529, 1531; or 864, 866, 868, 870, 872, 874, 876, 878, 880, 882, 884, 886, 888, 890, 892, 894, 896, 898, 900, 902, 904, 906, 908, 910, 912, 914, 916, 918, 920, 922; or 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072; or: 2, 4, 6, 8, 10, 12, 14, 16, 18, 20, 22, 24, 26, 28, 30, 32, 34; or 490, 492, 494, 496, 498, 500, 502, 504, 506, 508, 510, 512, 514, 516, 518, 520, 522, 524, 526, 528, 530, 532, 534, 536, 538, 540, 542, 544, 546, 548; or 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395; or 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226; or 1591, 1593, 1595, 1597, 1599, 1601, 1603, 1605, 1607, 1609, 1611, 1613, 1615, 1617; or 735, 737, 739, 741, 743, 745, 747, 749, 751, 753, 755, 757, 759, 761, 763, 765, 767, 769, 771, 773, 775, 777, 779, 781, 783; or 625, 627, 629, 631, 633, 635, 637, 639, 641, 643, 645, 647, 649, 651, 653, 655, 657, 659, 661, 663, 665; or 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, or 209 or an AtNAC6, WRKY17, AtNPR3, AtMYC1, AtMYB19, ERF058, CRF1, WRKY3, ZAT11, MYB111, SPATULA, or AtMYB50 clade polypeptide, wherein the AtNAC6, WRKY17, AtNPR3, AtMYC1, AtMYB19, ERF058, CRF1, WRKY3, ZAT11, MYB111, SPATULA, or AtMYB50 clade polypeptide is expressed in a photosynthetic tissue of the transgenic plant to a level that is effective in conferring greater photosynthetic resource use efficiency in the transgenic plant relative to a control plant that does not contain the recombinant polynucleotide;
(b) generating a plant from the plant cell or the plant tissue, wherein the plant comprises the recombinant polynucleotide;
(c) growing the plant; and
(d) measuring† an increase in photosynthetic resource use efficiency of at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 2%, 28%, 29%, or 30% relative to the control plant, or an increase in grain yield of at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 2%, 28%, 29%, or 30% or at least 1, 2, 3, 4, 5, 6, 7, 8, 9, 10, 11, 12, 13, 14, 15, 16, 17, 18, 19, 20 bushels per acre;
thereby producing the monocot plant with increased grain yield relative to the control plant; and/or 27. The method of embodiment 26, wherein the AtNAC6, WRKY17, AtNPR3, AtMYC1, AtMYB19, ERF058, CRF1, WRKY3, ZAT11, MYB111, SPATULA, or AtMYB50 clade polypeptide comprises a consensus sequence of SEQ ID NO: 1467, 1468, 1469 of the AtNAC6 clade, SEQ ID NO: 1558, 1559, 1560, 1561 of the WRKY17 clade, SEQ ID NO: 981, 982, 983, 984, 985, 986 of the AtNPR3 clade, SEQ ID NO: 1153, 1154 of the AtMYC1 clade, SEQ ID NO: 129, 130, or 133 of the AtMYB19 clade, SEQ ID NO: 579, 580, 581 of the ERF058 clade, SEQ ID NO: 441, 442 of the CRF1 clade, SEQ ID NO: 1299, 1300 of the WRKY3 clade, SEQ ID NO: 1646, 1647, 1648, of the ZAT11 clade, SEQ ID NO: 834, 835, 836 of the MYB111 clade, SEQ ID NO: 687 of the SPATULA clade, or SEQ ID NO: 302, 303, 304, 305 of the AtMYB50 clade.

28. A transgenic monocot plant produced by the method of embodiment 26; and/or

29. The transgenic monocot plant of embodiment 28, wherein transgenic monocot plant is a corn, wheat, rice, *Miscanthus, Setaria*, switchgrass, ryegrass, sugarcane, miscane, barley, or sorghum plant; and/or 30. The method of embodiment 26, wherein the promoter is a Cauliflower Mosaic 35S promoter, an RBCS3 promoter, an RBCS4 promoter, an At4g01060 promoter, an Os02g09720 promoter, an Os05g34510 promoter, an Os11g08230 promoter, an Os01g64390 promoter, an Os06g15760 promoter, an Os12g37560 promoter, an Os03g17420 promoter, an Os04g51000 promoter, an Os01g01960 promoter, an Os05g04990 promoter, an Os02g44970 promoter, an Os01g25530 promoter, an Os03g30650 promoter, an Os01g64910 promoter, an Os07g26810 promoter, an Os07g26820 promoter, an Os09g11220 promoter, an Os04g21800 promoter, an Os10g23840 promoter, an Os08g13850 promoter, an Os12g42980 promoter, an Os03g29280 promoter, an Os03g20650 promoter, or an Os06g43920 promoter (SEQ ID NO: 1693-1719, respectively), or a functional variant thereof, or a functional fragment thereof, or a promoter sequence that is at least 80% identical to SEQ ID NO: 1693-1719; and/or 31. The method of embodiment 28, wherein the AtNAC6, WRKY17, AtNPR3, AtMYC1, AtMYB19, ERF058, CRF1, WRKY3, ZAT11, MYB111, SPATULA, or AtMYB50 clade polypeptide has at least:
28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% in its amino acid sequence to the entire length of any of SEQ ID NO: 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433; or 1507, 1509, 1511, 1513, 1515, 1517, 1519, 1521, 1523, 1525, 1527, 1529, 1531; or 864, 866, 868, 870, 872, 874, 876, 878, 880, 882, 884, 886, 888, 890, 892, 894, 896, 898, 900, 902, 904, 906, 908, 910, 912, 914, 916, 918, 920, 922; or 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072; or: 2, 4, 6, 8, 10, 12, 14, 16, 18, 20, 22, 24, 26, 28, 30, 32, 34; or 490, 492, 494, 496, 498, 500, 502, 504, 506, 508, 510, 512, 514, 516, 518, 520, 522, 524, 526, 528, 530, 532, 534, 536, 538, 540, 542, 544, 546, 548; or 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395; or 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226; or 1591, 1593, 1595, 1597, 1599, 1601, 1603, 1605, 1607, 1609, 1611, 1613, 1615, 1617; or 735, 737, 739, 741, 743, 745, 747, 749, 751, 753, 755, 757, 759, 761, 763, 765, 767, 769, 771, 773, 775, 777, 779, 781, 783; or 625, 627, 629, 631, 633, 635, 637, 639, 641, 643, 645, 647, 649, 651, 653, 655, 657, 659, 661, 663, 665; or 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, or 209; or
37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% identity in its amino acid sequence to any of
a NAM domain of SEQ ID NO:1434, 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465, 1466; or
a Plant Zinc Cluster Domain of SEQ ID NO: 1507, 1532, 1533, 1534, 1535, 1536, 1537, 1538, 1539, 1540, 1541, 1542, 1543 1544; or
a BTB domain of SEQ ID NO:864 or 923-950; or
an ANK domain of SEQ ID NO 864, 951-980; or
a Myb or Myb-like DNA binding domain of SEQ ID NO: 2; 61-77, 95-111, 135, 210-285; or
a SANT domain of SEQ ID NO: 735-833; or
a WRKY Domain of SEQ ID NO: 1156, 1227-1298; 1507, 1545-1557; or
a Z-C2H2-1 domain of SEQ ID NO: 1591, 1618-1645; or
an AP2 domain of SEQ ID NO: 307, 396-440; 489, 549-578; or
a bHLH-MYC_N domain of SEQ ID NO: 1016 or 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129; and/or an HLH domain of 625, 666-686, 1016, 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130.

† In the above embodiments 4, 12, 23, and 24, greater photosynthetic resource use efficiency may be characterized by or measured as, but is not limited to, any one or more of following measurements or characteristics relative to a control plant. The measured or altered trait may be selected from the group consisting of:

(a) increased photosynthetic capacity, measured as an increase in the rate of light-saturated photosynthesis of at least 5%, 10%, 15%, 20%, 25%, 30%, 35%, or 40% when compared to the rate of light-saturated photosynthesis of a control leaf at the same leaf-internal $CO_2$ concentration. Optionally, measurements are made after 40 minutes of acclimation to a light intensity that is saturating for photosynthesis; and/or (b) increased photosynthetic rate, measured as an increase in the rate of light-saturated photosynthesis of at least 5%, 10%, 15%, 19%, 20%, 22%, 23%, 25%, 30%, 32%, 35%, or 40%. Optionally, measurements are made after 40 minutes of acclimation to a light intensity known to be saturating for photosynthesis; and/or (c) a decrease in the chlorophyll content of the leaf of at least 5%, 10%, 15%, 20%, 25%, 30%, 35%, or 40%, observed in the absence of a decrease in photosynthetic capacity; and/or (d) a decrease in the percentage of the leaf dry weight that is nitrogen of at least 0.5%, 1.0%, 1.5%, 2.0%, 2.5%, 3.0%, 3.5%, or 4.0% observed in the absence of a decrease in photosynthetic capacity or increase in dry weight; and/or (e) increased transpiration efficiency, measured as an increase in the rate of light-saturated photosynthesis relative to water loss via transpiration from the leaf, of at least 5%, 10%, 15%, 20%, 25%, 30%, 35%, or 40%; optionally, measurements are made after 40 minutes of acclimation to a light intensity of 700 µmol PAR $m^{-2}s^{-1}$; and/or (f) an increase in the resistance to water vapor diffusion out of the leaf that is exerted by the stomata, measured as a decrease in stomatal conductance to $H_2O$ loss from the leaf of at least 5%, 10%, 15%, 20%, 25%, 30%, 35%, or 40%; optionally, measurements were are after 40 minutes of acclimation to a light intensity of 700 µmol PAR m-2 s-1; and/or (g) a decrease in the resistance to carbon dioxide diffusion into the leaf that is exerted by the stomata, measured as an increase in stomatal conductance of at least 5%, 10%, 13%, 15%, 20%, 25%, 27%, 30%, 35%, 40%, 45%, 50%, 55%, 60%, 65%, or 68%; optionally, measurements were are after 40 minutes of acclimation to a light intensity of 700 µmol PAR m-2 s-1; and/or (h) a decrease in non-photochemical quenching of at least 2%, at least 3%, at least 4%, at least 5%, at least 6%, at least 7%, at least 8%, at least 9%, or at least 10%, for leaf measurements made after 40 minutes of acclimation to a light intensity of 700 µmol PAR $m^{-2}$ $s^{-1}$; and/or (i) a decrease in the ratio of the carbon isotope $^{12}C$ to $^{13}C$ found in either all the dried above-ground biomass, or specific components of the above-ground biomass, e.g., leaves or reproductive structures, of at least 0.5‰ (0.5 per mille), or at least 1.0‰, 1.5‰, 2.0‰, 2.5‰, 3.0‰, 3.5‰, or 4.0‰ measured as a decrease in the ratio of $^{12}C$ to $^{13}C$ relative to the controls with both ratio being expressed relative to the same standard; and/or (j) an increase in the total dry weight of above-ground plant material of at least 5%, 10%, 15%, 20%, 23%, 25%, 30%, 32%, 35%, 40%, 45%, 50%, 55%, 60%, 65%, 70%, or 75%.

All publications and patent applications mentioned in this specification are herein incorporated by reference to the same extent as if each individual publication or patent application was specifically and individually indicated to be incorporated by reference.

The present invention is not limited by the specific embodiments described herein. The invention now being fully described, it will be apparent to one of ordinary skill in the art that many changes and modifications can be made thereto without departing from the spirit or scope of the appended claims. Modifications that become apparent from the foregoing description and accompanying figures fall within the scope of the claims.

SEQUENCE LISTING (1719 sequences)

SEQ ID NO: 1 - DNA, 804 bp, Arabidopsis thaliana
  AtMYB19 (AT5G52260.1 or G1309)
atgaccaaatctggagagagaccaaaacagagacagaggaaagggttatggtcacctgaagaagaccagaagctcaagagtttcatcctctctcgtggccatgcttgctggaccactgttcccatcctagctggattgcaaaggaatgggaaaagctgcagattaaggtggattaattacctaagaccaggactaaagagggggtcgtttagtgaagaagaagaagagaccatcttgactttacattcttccttgggtaacaagtggtctcggattgcaaaatatttaccgggaagaacagacaacgagattaagaactattggcattcctatctgaagaagagatggctcaaatctcaaccacaactcaaaagccaaatatcagacctcacagaatctccttcttcactactttcttgcgggaaaagaaatctggaaaccgaaaccctagatcacgtgatctccttccagaaattttcagagaatccaacttcatcaccatccaaagaaagcaacaacaacatgatcatgaacaacagtaataacttgcctaaactgttcttctctgagtggatcagttcttcaaatccacacatcgattactcctctgcttttacagattccaagcacattaatgaaactcaagatcaaatcaatgaagaggaagtgatgatgatcaataacaacaactactcttcacttgaggatgtcatgctccgtacagattttttgcagcctgatcatgaatatgcaaattattattcttctggagatttcttcatcaacagtgaccaaaattatgtc

SEQ ID NO: 2 - protein, 268 aa, Arabidopsis thaliana
  AtMYB19 (AT5G52260.1), domain AAs 17-77, 70-112
MTKSGERPKQRQRKGLWSPEEDQKLKSFILSRGHACWTTVPILAGLQRNGKSCRLRWINYLRPGLKRGSFSEEEEETILTLHSSLGNKWSRIAKYLPGRTDNEIKNYWHSYLKKRWLKSQPQLKSQISDLTESPSSLLSCGKRNLETETLDHVISFQKFSENPTSSPSKESNNNMIMNNSNNLPKLFFSEWISSSNPHIDYSSAFTDSKHINETQDQINEEEVMMINNNNYSSLEDVMLRTDFLQPDHEYANYYSSGDFFINSDQNYV

SEQ ID NO: 3 - DNA, 849 bp, Arabidopsis thaliana
  AT4G25560.1
atggcgaagacgaaatatggagagagacataggaaagggttatggtcacctgaagaagacgagaagctaaggagcttcatcctctcttatggccattcttgctggaccactgttcccatcaaagctgggttacaaaggaatgggaagagctgcagattaagatggattaattacctaagaccagggttaaagagggatatgattagtgcagaagaagaagagactatcttgacgtttcattcttccttgggtaacaagtggtcgcaaatagctaaattcttaccgggaagaacagacaatgagataaagaactattggcactctcatttgaaaaagaaatggctcaagtctcagagcttacaagatgcaaaatctatttcccctccttcgtcttcatcatcatcacttgttgcttgtggaaaaagaaatccggaaaccttgatctcgaatcacgtgttctccttccagagacttctagagaacaaatcttcatctccctcacaagaaagcaacggaaataacagccatcaatgttcttctgctcctgagattccaaggcttttcttctctgaatggctttcttcttcatatccccacaccgattattcctctgagtttaccgactctaagcacagtcaagctccaaatgtcgaagagactctctcagcttatgaagaaatgggtgatgttgatcagttccattacaacgaaatgatgatcaacaacagcaactggactcttaacgacattgtgtttggttccaaatgtaagaagcaggagcatcatatttatagagaggcttcagattgtaattcttctgctgaattcttttctccatcaacaacgacg

SEQ ID NO: 4 - protein, 283 aa, Arabidopsis thaliana
  AT4G25560.1, domain AAs 15-75, 68-110
MAKTKYGERHRKGLWSPEEDEKLRSFILSYGHSCWTTVPIKAGLQRNGKSCRLRWINYLRPGLKRDMISAEEEETILTFHSSLGNKWSQIAKFLPGRTDNEIKNYWHSHLKKKWLKSQSLQDAKSISPPSSSSSSLVACGKRNPETLISNHVFSFQRLLENKSSSPSQESNGNNSHQCSSAPEIPRLFFSEWLSSSYPHTDYSSEFTDSKHSQAPNVEETLSAYEEMGDVDQFHYNEMMINNSNWTLNDIVFGSKCKKQEHHIYREASDCNSSAEFFSPSTTT

SEQ ID NO: 5 - DNA, 819 bp, Oryza sativa
  LOC_Os04g45020.1
atggggtgcaaggcgtgccagaagcccaaggtgcactaccggaagggcctgtggtcgccggaggaggaccagaagctccgcgacttcatcctccgctacggccacggctgctggagcgccgtccccgtgaaggccgggctgcagcgtaacggcaagagttgcaggctgagatggatcaattacctgaggccggggctgaagcacggcatgttttcccgagaggaagaagaaaccgtcatgaacctgcacgctacaatgggcaacaagtggtcacagatagcgcggcatctgcctggccggacggacaacgaggtgaagaactactggaactcgtacctcaagaagcgagtcgaaggcgcggaggctgcggccagaaaatccgccgagccggccgacgtcgtcaccggcagcccgaaccgcagcgagaccggccaagaacgcgtcgccgctgaccggccggcgagctccgagtcttccgggccggtcgagtcgtcgtcggccgacgactcgagcagcctcaccgagcccgcggcggggctcgccgccgtccggccgcacgcgcccgtgatccccaaggtcatgttcgccgactggttcgacatggactacgggactagcctcgccgggacggcgccgggcctgagctaccagggctcgtcgtcggtgcaggtcgacgtcccgtgcggcggcgccgtggactccctgcacgggctgggcgacggcggcttctgctgggacttcgacgacgcggccgatcacatgcagggaggaggagggctctgcgacctgctctccatgagcgagttcctcggcatcaac

SEQ ID NO: 6 - protein, 273 aa, Oryza sativa
  LOC_Os04g45020.1, domain AAs 18-78, 71-113
MGCKACQKPKVHYRKGLWSPEEDQKLRDFILRYGHGCWSAVPVKAGLQRNGKSCRLRWINYLRPGLKHGMFSREEEETVMNLHATMGNKWSQIARHLPGRTDNEVKNYWNSYLKKRVEGAEAAARKSAEPADVVTGSPNRSETGQERVAADRPASSESSGPVESSSADDSSSLTEPAAGLAAVRPHAPVIPKVMFADWFDMDYGTSLAGTAPGLSYQGSSSVQVDVPCGGAVDSLHGLGDGGFCWDFDDAADHMQGGGGLCDLLSMSEFLGIN

SEQ ID NO: 7 - DNA, 855 bp, Brachypodium distachyon
  Bradi5g16672.1
atggggtgcaagtcgtgccagaagcccaaggcgcaccatcggaagggcctgtggtcgccggaggaggaccagaagctccgcgactacatcatccgttatggccatagctgctggagcaccgtccccgtcaaggctggactgcagcggaacggcaagagctgcaggctgagatggatcaactacctgaggccggggctgaagcacggcatgttctcccaggaggaagaagagaccgtcatgagcctccacgccacactgggcaacaaatggtctcggatagcgcagcatctgccaggccggaccgacaacgaggtgaagaactactggaactcgtacctgaagaagcgcgtggagggcgcgcaggcggcaccagccaaatccgccggctcggactcgccccagagcccgacggcggcgctcagcgagagcggcgttaaacggccggagaactccggctcgtccgggccgccggaatcgtcgtcggccgacgactcgagctgcctcacggggcccgccggcgccgccgcggccctgatccggccgcacgcgcccgtgctccccaaggtcatgttcgcggactggctcgacatggacatggactacggcacgggcctgatggcgccgggcctggacgcgggcttcggagcgggccggtgcagcagcccggcccagggcgccgcgagccagcaggggtccgtgcaggtcgacggcccatcgtgcagcgccgtggattccttgcacgggctcggcggcggcatctgctgggacttcgacgcggcggatcagatgcacatgcagagcgggggaggagggttctgcgacctgctctccatgagcgagttccttgggatcaac

SEQ ID NO: 8 - protein, 285 aa, Brachypodium distachyon
  Bradi5g16672.1, domain AAs 18-78, 71-113
MGCKSCQKPKAHHRKGLWSPEEDQKLRDYIIRYGHSCWSTVPVKAGLQRNGKSCRLRWINYLRPGLKHGMFSQEEEETVMSLHATLGNKWSRIAQHLPGRTDNEVKNYWNSYLKKRVEGAQAAPAKSAGSDSPQSPTAALSESGVKRPENSGSSGPPESSSADDSSCLTGPAGAAAALIRPHAPVLPKVMFADWLDMDMDYGTGLMAPGLDAGFGAGRCSSPAQGAASQQGSVQVDGPSCSAVDSLHGLGGGICWDFDAADQMHMQSGGGGFCDLLSMSEFLGIN

SEQ ID NO: 9 - DNA, 873 bp, Zea mays
  GRMZM2G170049_T01
atggggtgcaaggcgtgcgacaagcccaagcccaactaccgcaagggcctgtggtcgccggaggaggaccagaagctccgcgactacattctcctccacggccacggctgctggagcgcgctccccgcgaaagccgggctccagcggaacggcaagagctgcaggctgcggtggatcaactaccttcggccggggctgaagcacggcatgttctccccggaggaggaggagacggtgatgagcctccacgccacgctcggcaacaagtggtccaggatcgcacggcacttgcctggcaggaccgacaacgaggtcaagaactactggaactcgtacctcaagaagagggtcgagggcaaggaccaggggcccagcacgcccgcgccggcggcgtccaattcggacgacgactcgcactgcgtcaagcagcgcagggacgacgacggcacggcggactccggcgcgtcggagccgcgcgagtcgtcgtcggccgacgactcgagctgcctgacggacccgcacgcctgcaggccccacgcgcccgtgccgcccaaggtcatgttcgcggactggctggacatggactacgtgggcggtgccctgccggcgacagcaccagcagcacctggtctgctcggcgctgcgggcgtggccacggccagcacgggcgaccgcgatcagcatcaggtgatgagcatgagccaggggtccgttcaggtggatgggccatccggtgccgatgtgtccctgcacggcttcgatgacagcggcgccggctgctgggagttccaggagcacttcgatgccatcgatcacatgcaggcggccggcttctgcgacctgctctccatgagcgactacttcggcctcgac

SEQ ID NO: 10 - protein, 291 aa, Zea mays
  GRMZM2G170049_T01, domain AAs 18-78, 71-113
MGCKACDKPKPNYRKGLWSPEEDQKLRDYILLHGHGCWSALPAKAGLQRNGKSCRLRWINYLRPGLKHGMFSPEEEETVMSLHATLGNKWSRIARHLPGRTDNEVKNYWNSYLKKRVEGKDQGPSTPAPAASNSDDDSHCVKQRRDDDGTADSGASEPRESSSADDSSCLTDPHACRPHAPVPPKVMFADWLDMDYVGGALPATAPAAPGLLGAAGVATASTGDRDQHQVMSMSQGSVQVDGPSGADVSLHGFDDSGAGCWEFQEHFDAIDHMQAAGFCDLLSMSDYFGLD

SEQ ID NO: 11 - DNA, 867 bp, Setaria italica
  Si012304m
atggggtgcaaggcgtgccagaagcccaaggtgcagtaccgcaagggcctgtggtcgccggaggaggacgagaagctccgcgacttcatcctccgctacggccacggctgctggagcgcgctccccgccaaggccgggctgcagcgcaacggcaagagctgcaggctgaggtggatcaactacctgaggccggggctgaagcacggcatgttctcccgggaggaggaggagaccgtcatgagcctccacgccaagcttggcaacaagtggtctcagatcgcgcggcacctgccgggccggaccgacaacgaggtgaagaactactggaactcgtacctcaagaagcgcgtcgagggcggcgcgcaggccaagtgcgcggcggacccggcgacacccgccggttccgacgtccgcgccgggagccccaaccccagcgacaacggtcgggaacgcgccaaccaccccgcgagctctgactcgtcggagccggtcgagtcgtcctcggccgacgactcgagctgcctcaccgtcaccgagcccgccagggcgggcgcggtgcggccgcacgctcccgtgctccccaaggtcatgttcgcggactggctcgacatggactacggcaccagcctggcggcgctgggtccggacgccggcgtcttcgacgtgagcgggcgcagcccggggcagggcctgagccaccaggggtccgtgcaggtggacggcccgtgcggcgcggtggattccctgcacgggctcggcgacggcggcatctgcggctgggggttcgacgcggcggtggatcagatggacgtgcagggaggagggttctgcgatctgctctccatgaccgagttccttgggatcaac

SEQ ID NO: 12 - protein, 289 aa, Setaria italica
  Si012304m, domain AAs 18-78, 71-113
MGCKACQKPKVQYRKGLWSPEEDEKLRDFILRYGHGCWSALPAKAGLQRNGKSCRLRWINYLRPGLKHGMFSREEEETVMSLHAKLGNKWSQIARHLPGRTDNEVKNYWNSYLKKRVEGGAQAKCAADPATPAGSDVRAGSPNPSDNGRERANHPASSDSSEPVESSSADDSSCLTVTEPARAGAVRPHAPVLPKVMFADWLDMDYGTSLAALGPDAGVFDVSGRSPGQGLSHQGSVQVDGPCGAVDSLHGLGDGGICGWGFDAAVDQMDVQGGGFCDLLSMTEFLGIN

SEQ ID NO: 13 - DNA, 939 bp, Citrus clementina
  clementine0.9_033485m
atgggatgcaagtcatcggaaaagccaattgcaaagccgaagccaaagcacagaaagggcttgtggtctcccgaagaagaccagaggctcaagaactatgtcctccagcatggccacccttgctggagctccgtccccatcaatgccggcttgcaaaggaatggaaagagctgcagactgagatggattaattatttgaggccaggacttaagagaggggtgttcaatatgcaagaagaagagacaatcctgaccgtccatcgcctgttaggaaacaagtggtctcaaattgctcagcatttgcctggaagaacagataacgagataaagaactattggcactcccatttgaagaaaaaattagccaaacttgaagaaatggaagcagctaatgcgacaactccaagctcagaaaatatggaatcttcaacttcccctaataacaatccctcaactcgcagctcaagctatgaatcgttgcaccacatggaaaaatcatcagccggtagtactgatcagtgtgcaactcagggtcagaaaagttgcttgccgaagcttttatttgcagagtggctgtcgcttgatcatgctaatgatggtagcttcgcaaattccttcgagcaagtggcttccaaggaaggctttaataataataataataataataataataataataataataataataataataatcagaactccaacttggtccaagattcgagtgatacatttatgaatggttacttgtccaatgagggagcatttggcggcgattttattcataacggattcaacaacagttttgttgatgaaatgttgagttcaagattcaaattcgaggatcatcagttttccggaattgggtttgttgattctatctctggggatgatgtatgtagtgctttgaatatgaataatgatgtaatgtacata

SEQ ID NO: 14 - protein, 313 aa, Citrus clementina
  clementine0.9_033485m, domain AAs 22-82, 75-117
MGCKSSEKPIAKPKPKHRKGLWSPEEDQRLKNYVLQHGHPCWSSVPINAGLQRNGKSCRLRWINYLRPGLKRGVFNMQEEETILTVHRLLGNKWSQIAQHLPGRTDNEIKNYWHSHLKKKLAKLEEMEAANATTPSSENMESSTSPNNNPSTRSSSYESLHHMEKSSAGSTDQCATQGQKSCLPKLLFAEWLSLDHANDGSFANSFEQVASKEGFNNNNNNNNNNNNNNNNNNQNSNLVQDSSDTFMNGYLSNEGAFGGDFIHNGFNNSFVDEMLSSRFKFEDHQFSGIGFVDSISGDDVCSALNMNNDVMYI

SEQ ID NO: 15 - DNA, 885 bp, Populus trichocarpa
  POPTR_0015s13190.1
atggggtgcaagtcatctgacatgccaaagctaaagccaaagccaaagcacaggaaaggcttgtggtcacctgaagaagatcaaaggctcagaaactatgtccttaaacatggccatggatgttggagctctgtccccattaatgctggcttgcagaggaatgggaagagctgcagactaagatggattaattacttgagaccaggattaaaaagagggacgttttctgcacaagaagaggagacaatcctggcccttcatcacatgttaggcaacaagtggtctcagatagcacagcatttgcctggaagaacagataatgagataaagaatcattggcattcctatttgaagaaaaatttgctcaaagacgaagggatggagtctttgaaaagaacaaaatctgacagctcaaactcagacattatggaactttcaccatctcccaagagactcaaaatgcaagcttcaagttttgagtcatcaatgagtgcagaaaaatcatcagctgatatcaaccggtcagttccgcagatgtttgagtctcctaacgaacctaaaggaagctccttattaccaaaggttatgtttgcagagtggctttcacttgaaagcttcgcgagtttaggtgagcctatggattcaaagactacacttgatcataatacaatcttccaagacaatttcttgcatgattacttactggatgaaagagcatttggcggcgagtatcataattcactaagcgatggttcgagcggcgacatttttagttcagaattcaggtttgagagccagagtccagggaatgagtttgattttagctctggagaggatttatgtagtgacttcaacttgagcaacattagtgatgtgatgtacata

SEQ ID NO: 16 - protein, 295 aa, Populus trichocarpa
  POPTR_0015s13190.1, domain AAs 22-82, 75-117
MGCKSSDMPKLKPKPKHRKGLWSPEEDQRLRNYVLKHGHGCWSSVPINAGLQRNGKSCRLRWINYLRPGLKRGTFSAQEEETILALHHMLGNKWSQIAQHLPGRTDNEIKNHWHSYLKKNLLKDEGMESLKRTKSDSSNSDIMELSPSPKRLKMQASSFESSMSAEKSSADINRSVPQMFESPNEPKGSSLLPKVMFAEWLSLESFASLGEPMDSKTTLDHNTIFQDNFLHDYLLDERAFGGEYHNSLSDGSSGDIFSSEFRFESQSPGNEFDFSSGEDLCSDFNLSNISDVMYI

SEQ ID NO: 17 - DNA, 807 bp, Eucalyptus grandis
  EUCGR.K00250.1
atggcactgaagtcatcagaaagaccaaaacccaagcacagaaagggattgtggtcacctgaagaagatcagaagctcaggaactatgtcctcaagcatggccatggttgctggagctctgtccccattaacaccggcttgcagaggaatggcaagagctgcagattaaggtggatcaattacttgaggcctggcctaaagagaggcatgttcaccatggaagaggaggagattattttttcccttcatcacttgataggcaacaagtggtctcaaatagcaaagcatttgccaggaaggacagataacgagataaagaatcactggcattcttatcttaagaagaaggtggcaaacaagactgaatctttatcgtcatcattagaagctcaccatcatgcccggagtcaatgtaccaattcggacaatgtggaatcttcgcctcctccagatcaaatccctccaaaccagaacccatcagttcatgcaccatcacaggagcaaaaggaaaagacatcatttgactttcagagggacgggctacgcagctacttgccccagattttcttcgccgagtggctgaatcaagctgatcaagggaacaacatccccaattacggcgacgctttcgatgactgcttgaatcttcaggacccccttgtgcctgatctatgcacgagtgattttggaaattcttatggtggtgaatatgttggtagtgagctaagtaacgggtctgctagtgctagcgtgagcgacatgtacagttcgcagttgaagttggagatgggatcaggtttcggggag

SEQ ID NO: 18 - protein, 269 aa, Eucalyptus grandis
  EUCGR.K00250.1, domain AAs 18-78, 71-113
MALKSSERPKPKHRKGLWSPEEDQKLRNYVLKHGHGCWSSVPINTGLQRNGKSCRLRWINYLRPGLKRGMFTMEEEEIIFSLHHLIGNKWSQIAKHLPGRTDNEIKNHWHSYLKKKVANKTESLSSSLEAHHHARSQCTNSDNVESSPPPDQIPPNQNPSVHAPSQEQKEKTSFDFQRDGLRSYLPQIFFAEWLNQADQGNNIPNYGDAFDDCLNLQDPLVPDLCTSDFGNSYGGEYVGSELSNGSASASVSDMYSSQLKLEMGSGFGE

SEQ ID NO: 19 - DNA, 885 bp, Eucalyptus grandis
  EUCGR.K00251.1
atggcattgaagtcatcagaaaggccaaagcccaagcacaggaagggcttgtggtcacctgaagaagaccagaggctcaggaactatatcctgaaccatggccatggttactggagctctgtccccattaacaccggcttgcagaggaatggcaagagctgcagattaaggtggatcaattacttgaggcctggcctaaagagaggcatgttcaccctggaagaagaggagattattttgtcccttcatcgcttgataggcaataagtggtctcaaatagcaaagcatttgccaggaaggaccgataatgagataaagaatcactggcattcttatcttaagaagaaggtggcaaataagactgaatcatcgtcatcatcagaagcccgccataatgcccagagtcaatgtaccaattcggacaatgtggaatcttcgccttcaccagatcaaatccccactaaccaaaacgcatcagttcatgcaccgtcacaggaacaaaaggaaaagatgtcattggactttccgaatgggggtccacgcagctgcttgcccaatattttcttcgccgagtggctgaatcaagctgatcaagggtacaacgttccgacctatggcgatgctttcgattatcgctcaaatattcaggactctcttgtgcatgattggtgcacaagcgattttgggaattctaatggcggtgagtatgttgggaatgagctaagtaaggggtccgctagtgccagcgtgagcgacatgtacagttcgcggttgaagtcggagatggatcaggtttcgggaggtgggttttacttggattatttctctggggatgatatctgtagtcagttcgacatgggcagtgatgtaaatatgatgtacata

SEQ ID NO: 20 - protein, 295 aa, Eucalyptus grandis
  EUCGR.K00251.1, domain AAs 18-78, 71-113
MALKSSERPKPKHRKGLWSPEEDQRLRNYILNHGHGYWSSVPINTGLQRNGKSCRLRWINYLRPGLKRGMFTLEEEEIILSLHRLIGNKWSQIAKHLPGRTDNEIKNHWHSYLKKKVANKTESSSSSEARHNAQSQCTNSDNVESSPSPDQIPTNQNASVHAPSQEQKEKMSLDFPNGGPRSCLPNIFFAEWLNQADQGYNVPTYGDAFDYRSNIQDSLVHDWCTSDFGNSNGGEYVGNELSKGSASASVSDMYSSRLKSEMDQVSGGGFYLDYFSGDDICSQFDMGSDVNMMYI

SEQ ID NO: 21 - DNA, 975 bp, Populus trichocarpa
  POPTR_0012s13260.1
atgccaaaggcattcattgcatccatcacaaagtccaagactctctttctcttgtacaagtcaccaatccttctcatcatcggtgttcttggcgaaatggggtgcaaatcatcagacaagccaaagccaaagctaaggcacaggaaaggcttgtggtcacctgaagaagatcaaaggcttggaagctatgtctttcaacatggccacggatgttggagctctgtccccattaatgctggcttgcagaggactgggaagagctgcagattaagatggattaattacttgagaccaggactgaaaagaggggcgttttctacagacgaagaagagacaatcctgacccttcatcgcatgttaggcaacaagtggtctcaaattgcacagcatttgcctggaagaacagacaatgagataaagaaccattggcattcctatttgaagaaaaagttgttcaaagctgaaggaatggaatctcctaataagactcaatctgccagctcaaactcagacaatatggatctttcaccctctcccaaaaggcttaaaatgcaaagtcctgaatcgtcaatgaatatggaaaaaccatcaactgatatcgaccggccggtacttccacggatgtttgactatcttaaagaacctaacagaagctccttattaccaaaggttatgtttgctgagtggctctcacttgacagctttgcaagttcaggtgagcctgtggtttcaaagagtacattcgatcataatccaagcttccaagacactagtttcatgcatcattacttactggaagaaggagcatttggtggcgactatcaaaattctctaagcgatggttcgagcggcgacatttttagttcagaattcaaatttgaaagccagagtccaggaaatgagtttgattttagctctggagaggatttatgtagggaattcaacttccgtaatattggtgatgtgatgtacata

SEQ ID NO: 22 - protein, 325 aa, Populus trichocarpa
  POPTR_0012s13260.1, domain AAs 52-112, 105-147
MPKAFIASITKSKTLFLLYKSPILLIIGVLGEMGCKSSDKPKPKLRHRKGLWSPEEDQRLGSYVFQHGHGCWSSVPINAGLQRTGKSCRLRWINYLRPGLKRGAFSTDEEETILTLHRMLGNKWSQIAQHLPGRTDNEIKNHWHSYLKKKLFKAEGMESPNKTQSASSNSDNMDLSPSPKRLKMQSPESSMNMEKPSTDIDRPVLPRMFDYLKEPNRSSLLPKVMFAEWLSLDSFASSGEPVVSKSTFDHNPSFQDTSFMHHYLLEEGAFGGDYQNSLSDGSSGDIFSSEFKFESQSPGNEFDFSSGEDLCREFNFRNIGDVMYI

SEQ ID NO: 23 - DNA, 873 bp, Glycine max
  Glyma16g31280.1
atggagagccagccactagaaaaagcaaaaccaaaatacagaaaaggcttatggtcacctgaagaagataataaactcagaaaccatatcattaagcatggtcatggctgctggagctctgtccctattaaggcaggcttgcaaagaaatgggaagagctgtagactaaggtggattaactacttgaggccaggattgaagagaggggtgttcagcaaacatgaggaagatacaatcatggtcctacaccatatgttaggaaacaagtggtctcaaatagcacagcatttgccaggaaggactgacaatgagataaaaaattattggcattcatatttgaaaaagaaagagatcaaagccaaggaaatggaatctgataaagaaattcagcatgctagctcaagttcagacacaatggaaaactcactctctcctcagaaacttgcaacacaagatccaagttatagtttgttagaaaacctggacaaatcaatagcacacaatgataactttttctcacaaagctataacttttccaaggaggcttgtcagagttccctaccattaccaaaactcctattttctgagtggctttcagtggatcaagtagatggtggaagctcagtgaattctgatgattccttggtcttggggaatgaatttgatcaaaattcaactttccaagaagctataatgcatatgttagaagaaaactttggtgaagagtatcataatagtctaattcacagttcaaccactgaggtctacaattcacaactaaagtcaacaaatcaagtggatggaagtgacttcatcaattgtattcccgggaatgagttgtgtagcaatttcagcctaaccaatcatgctatg

SEQ ID NO: 24 - protein, 291 aa, Glycine max
  Glyma16g31280.1, domain AAs 18-78, 71-113
MESQPLEKAKPKYRKGLWSPEEDNKLRNHIIKHGHGCWSSVPIKAGLQRNGKSCRLRWINYLRPGLKRGVFSKHEEDTIMVLHHMLGNKWSQIAQHLPGRTDNEIKNYWHSYLKKKEIKAKEMESDKEIQHASSSSDTMENSLSPQKLATQDPSYSLLENLDKSIAHNDNFFSQSYNFSKEACQSSLPLPKLLFSEWLSVDQVDGGSSVNSDDSLVLGNEFDQNSTFQEAIMHMLEENFGEEYHNSLIHSSTTEVYNSQLKSTNQVDGSDFINCIPGNELCSNFSLTNHAM

SEQ ID NO: 25 - DNA, 786 bp, Glycine max
  Glyma09g25590.1
atggagagcaagccactagaaaaagcaaaaccaaaatacagaaagggcttatggtcaccagaagaagataataagctcagaaatcatatcattaagcatggtcatggctgctggagctctgtccctattaaggcaggcttgcaaagaaatgggaagagctgcagactaaggtggattaactacttgaggccaggattgaagagaggggtgttcagcaaacatgagaaagatacaatcatggccctacaccatatgttaggaaacaagtggtctcagatagcacagcatttgccaggaaggactgacaatgaggtaaaaaattactggcattcatatttgaaaaagaaagtcatcaaagctaaggaaatggaatctgataaacaaattcaacatgccggctcaagttcagacacagtggaaaacgcactctctcctcagaaacttgcaacacaagattcaagttatgggttgttagaaaaccttgacaaatcaatagcacaaaatgataactttttctcgaaaagctataacttttccaaggaggcttatcagagttctctaccactaccaaaactcttattttctgagtggctatcagtggatcaagagtatcataatcgtctaattcacagttcaaccactgaggtctataattcacaaataaagtcaacaaatcaaatggatggaagtgatttcatgaattgtattcccgggaatgagttacgtagcaatttcagcctaaccaatcatggtgagttggaaggagaagaatacaatgcaattcct

SEQ ID NO: 26 - protein, 262 aa, Glycine max
  Glyma09g25590.1, domain AAs 18-78, 71-113
MESKPLEKAKPKYRKGLWSPEEDNKLRNHIIKHGHGCWSSVPIKAGLQRNGKSCRLRWINYLRPGLKRGVFSKHEKDTIMALHHMLGNKWSQIAQHLPGRTDNEVKNYWHSYLKKKVIKAKEMESDKQIQHAGSSSDTVENALSPQKLATQDSSYGLLENLDKSIAQNDNFFSKSYNFSKEAYQSSLPLPKLLFSEWLSVDQEYHNRLIHSSTTEVYNSQIKSTNQMDGSDFMNCIPGNELRSNFSLTNHGELEGEEYNAIP

SEQ ID NO: 27 - DNA, 837 bp, Solanum lycopersicum
  Solyc03g025870.2.1
atggggtgcaaattggcagctgagaagccaaaacaaaaacacaagaagggattatggtctcctgatgaagatgataggctcaaaaattatatgattaagcatggtcatggatgttggagctctgttcccattaatgctggcttgcaaagaaatggaaagagttgtagactgagatggattaattatttaaggcctggcttaaagagaggggcatttagcttagaagaggaagacataatattgacccttcatgccatgtttggcaacaaatggtctcagattgcacaacagttacctggaagaacggataacgagataaagaatcactggcactcgtatttaaagaaaagagtgtccaaaatgggagaaaatgaagggcacactaagcctgggaaaacagattcttcttcaccttctttaaagaaattgactccacagaattcaagtttggattcatttgaacatattgaaggatcattagcagattcagatcaatctgtttatccaagagagactcaaaagagtaatttacctaaagtattattcgcggaatggctttcgttggatcagtttaatggacaagattttcaaaactcagggagtttcagttttgaaccttgcaagagtaactttgtgtataataataatgcagagttacatgacatactcatgcatagtttaccgatgaacaacgatgatgggaatggcgtaaatcaagaggttcttcacaatgatattttcccaccacaactcaagtttgaggatacattgtctggtaacggatttgaggagtttatgtcaagggagttcaatattaacgacgatgtgatgtacata

SEQ ID NO: 28 - protein, 279 aa, Solanum lycopersicum
  Solyc03g025870.2.1, domain AAs 19-79, 72-114
MGCKLAAEKPKQKHKKGLWSPDEDDRLKNYMIKHGHGCWSSVPINAGLQRNGKSCRLRWINYLRPGLKRGAFSLEEEDIILTLHAMFGNKWSQIAQQLPGRTDNEIKNHWHSYLKKRVSKMGENEGHTKPGKTDSSSPSLKKLTPQNSSLDSFEHIEGSLADSDQSVYPRETQKSNLPKVLFAEWLSLDQFNGQDFQNSGSFSFEPCKSNFVYNNNAELHDILMHSLPMNNDDGNGVNQEVLHNDIFPPQLKFEDTLSGNGFEEFMSREFNINDDVMYI

SEQ ID NO: 29 - DNA, 894 bp, Vitis vinifera
  GSVIVT01028984001
atggggtgtaattcattggagaagtcgaagaccaagcccaaacaccgaaaggggttatggtcaccggaagaagatgctaggctcagaaactatgtcctcaaatatggccttggctgctggagctccgtccctgttaacgccggtttgcaaaggaatggaaagagctgcagattaaggtggattaactacttaagaccaggattaaaacgcgggatgtttacgatcgaggaggaagagacgatcatggcccttcatcgcttgttaggcaacaagtggtctcagatagcgcagaattttcctggaagaactgataatgagattaagaactactggcattcatgtctcaagaagaaagtggtgaaagctcaggaaatggaagttcatatgaactcccaatgcatcaactctaactcacagagcattgattcttcaacttcacaagaaaagccatcaatccaacttccgggtttcgaatcgtttgaaaacatgaaaggatcatcttcaacagatactgatcagtccattccacagatgttggactgtcctagagtggacacgcaggaaagccccttgccgaagattttattcgcagagtggctttctcttgaccatatttacggccagctctttgttaattcaggcgagtcagtcatttccaaggatactcttgatcagcatgatccaacctttcaagacaatttcacgcatggtttcctactgaacgaggagtcatatgtaggtgaattgcaccatggcctaagcaatgattcgtccagtgacatgttttcgccgcaatttaagttcgagagccagactccgggaagtgggatatgtgattttgtgtatggggatgaaatatgcagtgatttcaacatgaacggccatgtaatgtac

SEQ ID NO: 30 - protein, 298 aa, Vitis vinifera
  GSVIVT01028984001, domain AAs 20-80, 73-115
MGCNSLEKSKTKPKHRKGLWSPEEDARLRNYVLKYGLGCWSSVPVNAGLQRNGKSCRLRWINYLRPGLKRGMFTIEEEETIMALHRLLGNKWSQIAQNFPGRTDNEIKNYWHSCLKKKVVKAQEMEVHMNSQCINSNSQSIDSSTSQEKPSIQLPGFESFENMKGSSSTDTDQSIPQMLDCPRVDTQESPLPKILFAEWLSLDHIYGQLFVNSGESVISKDTLDQHDPTFQDNFTHGFLLNEESYVGELHHGLSNDSSSDMFSPQFKFESQTPGSGICDFVYGDEICSDFNMNGHVMY

SEQ ID NO: 31 - DNA, 723 bp, Eucalyptus grandis
  EUCGR.A02796.1
atgggatgcaagtcagtggaaaaaccaaaggcaaggcacagaaaggggttgtggtcaccagatgaagaccagaggctcagaaactacatccataaacacggctacagttgctggagctcagttcccatcaatgcaggtttgcagaggaatggtaagagctgcagattaaggtggattaattacctgaggccaggattaaagagaggcgcgttcacagtacaggaggaagagacaattttgaacctccaccacttgttaggcaacaagtggtctcaaatagcacagcatctccctggaaggaccgataacgaaataaagaatcattggcattcttatcttaagaagaagattaatatcaaagctgacgaatctcaccttcagatgccgagcaattcagactctgtgggatctccgaactctacggactttccatctgatcacacccaaagttctgatacaacggaatatacaaaaagctcagcttctcaaattccgaaaattttcaaccccacaaaagagggtgaaagctcattgccgacgcttctttttgaggagtggctttctctggataattctcctggaggaagtttcacaaaccatgctgaatcacaagatcaaatttcgggaaacgggcttgtgcagtgtctttctggggatgatctttgtatcctttccaagtcaggctgttcacctgaagaagtgattagccgagaaatattgaaa

SEQ ID NO: 32 - protein, 241 aa, Eucalyptus grandis
  EUCGR.A02796.1, domain AAs 18-78, 71-113
MGCKSVEKPKARHRKGLWSPDEDQRLRNYIHKHGYSCWSSVPINAGLQRNGKSCRLRWINYLRPGLKRGAFTVQEEETILNLHHLLGNKWSQIAQHLPGRTDNEIKNHWHSYLKKKINIKADESHLQMPSNSDSVGSPNSTDFPSDHTQSSDTTEYTKSSASQIPKIFNPTKEGESSLPTLLFEEWLSLDNSPGGSFTNHAESQDQISGNGLVQCLSGDDLCILSKSGCSPEEVISREILK

SEQ ID NO: 33 - DNA, 783 bp, Arabidopsis thaliana
  AT3G48920.1
atggtgtttaaatcagaaaaatcaaaccgggaaatgaaatcaaaggagaagcaaaggaagggattatggtcacccgaggaagatgagaagcttaggagtcatgtcctcaaatatggccatggatgctggagtactattcctcttcaagctggattgcagaggaatgggaagagttgtagattaaggtgggttaattatttaagacctggacttaagaagtctttattcactaaacaagaggaaactatacttctttcacttcattccatgttgggtaacaaatggtctcagatatcgaaattcttaccaggaagaaccgacaacgagatcaaaaactattggcattctaatctaaagaagggtgtaactttgaaacaacatgaaaccacaaaaaaacatcaaacacctttaatcacaaactcacttgaggccttgcagagttcaactgaaagatcttcttcatctatcaatgtcggagaaacgtctaatgctcaaacctcaagcttttcgccaaatctcgtgttctcggaatggttagatcatagtttgcttatggatcagtcacctcaaaagtctagctatgttcaaaatcttgttttaccggaagagagaggattcattggaccatgtggccctcgttatttgggaaacgactctttgcctgatttcgtgccaaattcagaatttttgttggatgatgagatatcatctgagatcgagttctgtacttcattttcagacaactttttgttcgatggtctcatcaacgagctacgaccaatg

SEQ ID NO: 34 - protein, 261 aa, Arabidopsis thaliana
  AT3G48920.1, domain AAs 23-83, 76-118
MVFKSEKSNREMKSKEKQRKGLWSPEEDEKLRSHVLKYGHGCWSTIPLQAGLQRNGKSCRLRWVNYLRPGLKKSLFTKQEETILLSLHSMLGNKWSQISKFLPGRTDNEIKNYWHSNLKKGVTLKQHETTKKHQTPLITNSLEALQSSTERSSSSINVGETSNAQTSSFSPNLVFSEWLDHSLLMDQSPQKSSYVQNLVLPEERGFIGPCGPRYLGNDSLPDFVPNSEFLLDDEISSEIEFCTSFSDNFLFDGLINELRPM

SEQ ID NO: 35 - DNA, 1059 bp, Solanum lycopersicum
  Solyc11g065840.1.1
atgaggaagcctgagttctcctcctcctcctcttcctcctccgcaaagaacaataacaataacaataataataacacgaacgtgaagctaagaaaagggttgtggtctccagaggaagatgaaaagcttatgcattatatgctaacaaatggacaagggtgttggagtgatgtagcaagaaatgctggattacaaagatgtggaaagagttgtagactcagatggatcaattatttgaggccagatcttaagagaggtgcattttcacctcaagaagaagaacatattatccatttacattccattcttggtaacaggtggtctcaaatagctgcacgtttgcctggacgtactgataatgaaatcaagaatttttggaattcgacattgaaaaagaggctaaagaactcatcatcatcttctacaccatcaccaaatgcaagtgattcatcctcagatcatccctccaaagaactcaatatgggagtcactcaacaaggattcatgccaatgctcaaacataacctaatgtccatgtacatggattcaaccacctctccttcttcctcgtctatagccctaaataccataaatattgatcctttgcccaccctcgaacacaccttaataaacatgcctaatggattcaacgcgccctcatacttgagtactacacaaccatgcttggtacaaggtgggaatattgtgagtgctaatggtggaaatcttttttatgggaataaccatgggatatttggagggaatcttagtatggaaggtcatgaactctatgttccaccattggagaatgtaagtattgagtatcaaaatgttgaaaatgggaattttagtcatcatcaaaacaacaataaccctaacaacatgaccaacttgatcaatactagccataatttcaatacttgtagtaatatcaaagtagaaaattttggagggatagggaattattgggaaggagatgacctaaaagtgggagagtgggacttggaggaattgatgaaggatgtttcacctttcccttttcttgatttccaagttgaa

SEQ ID NO: 36 - protein, 353 aa, Solanum lycopersicum
  Solyc11g065840.1.1
MRKPEFSSSSSSSSAKNNNNNNNNNTNVKLRKGLWSPEEDEKLMHYMLTNGQGCWSDVARNAGLQRCGKSCRLRWINYLRPDLKRGAFSPQEEEHIIHLHSILGNRWSQIAARLPGRTDNEIKNFWNSTLKKRLKNSSSSSTPSPNASDSSSDHPSKELNMGVTQQGFMPMLKHNLMSMYMDSTTSPSSSSIALNTINIDPLPTLEHTLINMPNGFNAPSYLSTTQPCLVQGGNIVSANGGNLFYGNNHGIFGGNLSMEGHELYVPPLENVSIEYQNVENGNFSHHQNNNNPNNMTNLINTSHNFNTCSNIKVENFGGIGNYWEGDDLKVGEWDLEELMKDVSPFPFLDFQVE

SEQ ID NO: 37 - DNA, 1002 bp, Glycine max
  Glyma15g03920.1
atgaggaagccagaggcgagtaataataatactaaaaacaacaacaacaatagcaagaagcttagaaaggggttgtggtcacctgaagaagatgacaagctcatgaactacatgctaaaccatggacaagggtgttggagcgatgtggcaagaaatgctggcctccaaaggtgtggcaaaagttgtcgccttcgatggatcaattacttgaggcctgatcttaagagaggtgcattctcaccccaagaagaggaactcatcatccacttccattcccttcttggaaacagatggtctcaaatagcggcgcgtttgcctgggcgaaccgacaatgaaataaaaaacttttggaattcgacgataaagaaaagactcaggaatatgtcttccacgaccaccacaacctcaccctcaccctcatcaaatgcaagcgagacctcaatatccgagcctagtaataaagacctcaacatgggagggtttatttccacacaacataatcaacacgcaggctttgttcctatgttcggttcatctccatcaccatcaataatgcaaaccggtacagttttcaataccttgattgacagattgcctatgctggagcatggactaaacatgccagcttctggagggtacttcgaaggcacaggtattccttgcttttcgcaaagtgaagttaacaaattaggttcttgttatttagaaaacggagtatttgggagaagtgtaaatatcggggtagaaggggatatgtttgttcctcccctagagaatgctacatgcagcaggagagaaacaactaacagcagttactttgacgatgacataaatagtattcttaataactgcaacattggcataggtgaaaataaggctcatgatggggtggagaatttgtttcaacaagagttagccactgccactgccacaggagaatgggactttgaggagttgatgaaattagatgtttcctcctttccgtttcttgatttttcatac

SEQ ID NO: 38 - protein, 334 aa, Glycine max
  Glyma15g03920.1
MRKPEASNNNTKNNNNNSKKLRKGLWSPEEDDKLMNYMLNHGQGCWSDVARNAGLQRCGKSCRLRWINYLRPDLKRGAFSPQEEELIIHFHSLLGNRWSQIAARLPGRTDNEIKNFWNSTIKKRLRNMSSTTTTTSPSPSSNASETSISEPSNKDLNMGGFISTQHNQHAGFVPMFGSSPSPSIMQTGTVFNTLIDRLPMLEHGLNMPASGGYFEGTGIPCFSQSEVNKLGSCYLENGVFGRSVNIGVEGDMFVPPLENATCSRRETTNSSYFDDDINSILNNCNIGIGENKAHDGVENLFQQELATATATGEWDFEELMKLDVSSFPFLDFSY

SEQ ID NO: 39 - DNA, 828 bp, Glycine max
  Glyma12g06180.1
atgaggaagcccgaggtttctggaaacaacaacaacaacaacaacattaataacaagcttagaaaagggttgtggtcacctgaagaagatgacaagctcatgaactacatgctaaacagtggacaaggttgttggagcgatgtagccagaaatgctggccttcaaaggtgtggcaaaagttgtcgccttcgatggatcaactacttgaggcctgatcttaaacgaggtgcattctcacaacaagaagaggaactcatcatccacttgcattcccttctcggaaacagatggtctcaaatagcggcgcgcttaccagggagaacagacaatgaaattaagaatttttggaattcaacaataaagaaaagactcaagaacatgtcatccaacacctcaccaaatggaagcgagtcctcatatgagcctaataacagagaccttaacatggcagggtttactacttctaatacccaagatcaacaacatgctgattttatgcctatgttcaattcatcatctcaatcaccctccatgcatgccatggttctcaattccataattgacaggttgcctatgctagagcatggactaaacatgccatgttctgttgacaacaaagggatttatttggaaaatggaggagtatttgggagtgtaaatattggtgcagaaggggatgtgtatgttccccctctagagagtgttagcactacttctgaccataacctgaaaggctggtggggtggagaatttgtttcaggaagagttaaccattggagagtgggacttggaggagttaatgaaagatgtttcatcctttccctttct

SEQ ID NO: 40 - protein, 276 aa, Glycine max
  Glyma12g06180.1
MRKPEVSGNNNNNNNINNKLRKGLWSPEEDDKLMNYMLNSGQGCWSDVARNAGLQRCGKSCRLRWINYLRPDLKRGAFSQQEEELIIHLHSLLGNRWSQIAARLPGRTDNEIKNFWNSTIKKRLKNMSSNTSPNGSESSYEPNNRDLNMAGFTTSNTQDQQHADFMPMFNSSSQSPSMHAMVLNSIIDRLPMLEHGLNMPCSVDNKGIYLENGGVFGSVNIGAEGDVYVPPLESVSTTSDHNLKGWWGGEFVSGRVNHWRVGLGGVNERCFILSLS

SEQ ID NO: 41 - DNA, 887 bp, Glycine max
  Glyma11g14200.1
atgaggaagcccgaggtttctggaaaaaacaacaacattaataacaagcttagaaaggggttgtggtcacctgaagaagatgacaagctcatgaactacatgctaaacagtggacaaggttgttggagcgatgtagccagaaatgcgggccttcaaaggtgtggcaaaagttgtcgccttcgatggatcaattacttgaggcctgatcttaaacgaggtgcattctcaccacaagaagaggaaatcatcatccatttgcattcccttctcggaaacagatggtctcaaatagcagcgcgcttaccagggagaactgacaatgaaattaagaacttttggaattcaacaataaagaaaagactcaagaacttgtcctccaacacctcaccaaatggaagcgagtcatcatatgagcccaacaacaaagaccttaacatggcagggtttactacttctaatacccaacaaaatcaacaacatgctgattttatgcctatgttgcctatgctagagcatggactaaacatgacaagttctggtggattcttcaacagcaaagggccatgcttctcatcatcacaaagagtatttgggagtgtaaatattggtgcagaaggggatatgtatgttcctcctctagagagtgttagcactacttctgaccattataacctgaaattggagagtacgtgcaacacagatactaacaatagtaattactttgatgacataaacagtatcatccttaataactgcaacattaataatagcaacaatattaagagagctgaaaatagggctggtggggtggagaatttgtttcaagaagagttaaccattggagagtgggacttagaggagttgatgaaagatgtttcatcctttcc

SEQ ID NO: 42 - protein, 296 aa, Glycine max
  misc_feature (296)..(296): Xaa can be any naturally occurring amino acid
  Glyma11g14200.1
MRKPEVSGKNNNINNKLRKGLWSPEEDDKLMNYMLNSGQGCWSDVARNAGLQRCGKSCRLRWINYLRPDLKRGAFSPQEEEIIIHLHSLLGNRWSQIAARLPGRTDNEIKNFWNSTIKKRLKNLSSNTSPNGSESSYEPNNKDLNMAGFTTSNTQQNQQHADFMPMLPMLEHGLNMTSSGGFFNSKGPCFSSSQRVFGSVNIGAEGDMYVPPLESVSTTSDHYNLKLESTCNTDTNNSNYFDDINSIILNNCNINNSNNIKRAENRAGGVENLFQEELTIGEWDLEELMKDVSSFX

SEQ ID NO: 43 - DNA, 840 bp, Arabidopsis thaliana
  AT5G12870.1
atgaggaagccagaggtagccattgcagctagtactcaccaagtaaagaagatgaagaagggactttggtctcctgaggaagactcaaagctgatgcaatacatgttaagcaatggacaaggatgttggagtgatgttgcgaaaaacgcaggacttcaaagatgtggcaaaagctgccgtcttcgttggatcaactatcttcgtcctgacctcaagcgtggcgctttctctcctcaagaagaggatctcatcattcgctttcattccatcctcggcaacaggtggtctcagattgcagcacgattgcctggtcggaccgataacgagatcaagaatttctggaactcaacaataaagaaaaggctaaagaagatgtccgatacctccaacttaatcaacaactcatcctcatcacccaacacagcaagcgattcctcttctaattccgcatcttctttggatattaaagacattataggaagcttcatgtccttacaagaacaaggcttcgtcaacccttccttgacccacatacaaaccaacaatccatttccaacgggaaacatgatcagccacccgtgcaatgacgattttaccccttatgtagatggtatctatggagtaaacgcaggggtacaaggggaactctacttcccacctttggaatgtgaagaaggtgattggtacaatgcaaatataaacaaccacttagacgagttgaacactaatggatccggaaacgcacctgagggtatgagaccagtggaagaattttgggaccttgaccagttgatgaacactgaggttccttcgttttacttcaacttcaaacaaagcata

SEQ ID NO: 44 - protein, 280 aa, Arabidopsis thaliana
  AT5G12870.1
MRKPEVAIAASTHQVKKMKKGLWSPEEDSKLMQYMLSNGQGCWSDVAKNAGLQRCGKSCRLRWINYLRPDLKRGAFSPQEEDLIIRFHSILGNRWSQIAARLPGRTDNEIKNFWNSTIKKRLKKMSDTSNLINNSSSSPNTASDSSSNSASSLDIKDIIGSFMSLQEQGFVNPSLTHIQTNNPFPTGNMISHPCNDDFTPYVDGIYGVNAGVQGELYFPPLECEEGDWYNANINNHLDELNTNGSGNAPEGMRPVEEFWDLDQLMNTEVPSFYFNFKQSI

SEQ ID NO: 45 - DNA, 1056 bp, Solanum lycopersicum
  Solyc01g087130.2.1
atgaggaagccggaacacaataatacaacgatgaaggagaaggagaaggagaaagtgaacaagttagggaaattaagaaaaggtttatggtcaccagaagaagatgaaaagttgatgagttacatgttaagaaatggtcaaggatgttggagtgacattgctagaaatgctggattacaaagatgtggtaagagttgtcgtcttagatggattaattacttgaggcctgaccttaaacgcggcgccttttctcttcaagaagaagaactcattgttcatttgcattctattctgggaaataggtggtcacaaattgcggctcgtctacctgggaggacagataatgaaatcaagaatttctggaattccacgataaaaaagagatcaaaaaacaacaacaacagcacgccatcgcccaacacgagtgattcttccattggaggaatatttccaatgcaagggcacgatgtaaataatgttatggcaacgttatgcatggataattcatcgtctactacttcaggatcatccatgcaagccatggtacctttcaaccctttccctcagcttgatagtacaagctacgatatatctggattagtcgggccagtgaatttaggtcaatttggttgtagtggaggtgatggtggatttttggactatggagttgtggaaacttatagtatgatgggtttaggaagtgatgaattttcaataccttctttagagggtgttcataataagagtactactactatgggagagagtaataataatagtaatgttgattttagtagtaataatattgttagtggtgctaatgactatgattccatgattgagaagaaaaataatacaaacgttaacaacaacaacaaccaacacttgatgaatatgagtggaattagtgatcaaagcctaaaggttgaagactatatggttggttttgggaatcatcatcattggcatggagaaagcttaagaattggagaatttgattgggaaggtttgttggcaaatgtttcctctttaccttaccttgattttcaagttgaa

SEQ ID NO: 46 - protein, 352 aa, Solanum lycopersicum
  Solyc01g087130.2.1
MRKPEHNNTTMKEKEKEKVNKLGKLRKGLWSPEEDEKLMSYMLRNGQGCWSDIARNAGLQRCGKSCRLRWINYLRPDLKRGAFSLQEEELIVHLHSILGNRWSQIAARLPGRTDNEIKNFWNSTIKKRSKNNNNSTPSPNTSDSSIGGIFPMQGHDVNNVMATLCMDNSSSTTSGSSMQAMVPFNPFPQLDSTSYDISGLVGPVNLGQFGCSGGDGGFLDYGVVETYSMMGLGSDEFSIPSLEGVHNKSTTTMGESNNNSNVDFSSNNIVSGANDYDSMIEKKNNTNVNNNNNQHLMNMSGISDQSLKVEDYMVGFGNHHHWHGESLRIGEFDWEGLLANVSSLPYLDFQVE

SEQ ID NO: 47 - DNA, 1008 bp, Glycine max
  Glyma19g05080.1
atgaggaaacctgatatgatgggaaaagacaaaatcaacaacaacattaagagcaagctaaggaagggtttgtggtcacctgaggaagatgagaagctcctaaggtatatgatcactaagggacaagggtgttggagtgacattgctaggaatgctggtcttcaaaggtgcggcaaaagttgccgtcttcgttggattaactacttgagacctgatctcaaacgtggtgcattttcacctcaagaggaagaagtcatcattcacttgcactccattcttggcaacagatggtctcaaattgccgcacgtctccctggtcgcacagacaatgagatcaagaatttctggaactccacactgaagaaaaggttgaaaatgaacaacaataactccactttatcaccaaacaatagtgactcatcagggcctaaagatgtcaatgtcatgggtggaatcatgtccatgaacgagcatgacctcatgaccatgtgcatggactcctcctcatcaacatcatcatcatcatgcatgcaatccatgcatgccaccaacatggtactaactaacccctttcccttgttgcccaacaaccgttatgacatgatgaccggtgcaaccggtttccttgacaacatggctgctgcatgcttaacccaagttggcatggtagatcatgatcatggggttgttcatgggacattggagcctaataaaacgcgtttaggaagcgacttttcccttcctccactagaaagtagaagcattgaggacaatagtagtaccccaattgatcatgtgaaaagccataacaacaacaaccacttcaagaatagttgcttcaataacactgatcattaccatcatattcaaagctccaacaacgtagttgtagaggatttgtttgggtttggaaatcatgggcaaggggaaaactttagaatgggagaatgggaccttgagggcttgatgcaagacatttcctattttccttcccttgatttccaagtt

SEQ ID NO: 48 - protein, 336 aa, Glycine max
  Glyma19g05080.1
MRKPDMMGKDKINNNIKSKLRKGLWSPEEDEKLLRYMITKGQGCWSDIARNAGLQRCGKSCRLRWINYLRPDLKRGAFSPQEEEVIIHLHSILGNRWSQIAARLPGRTDNEIKNFWNSTLKKRLKMNNNNSTLSPNNSDSSGPKDVNVMGGIMSMNEHDLMTMCMDSSSSTSSSSCMQSMHATNMVLTNPFPLLPNNRYDMMTGATGFLDNMAAACLTQVGMVDHDHGVVHGTLEPNKTRLGSDFSLPPLESRSIEDNSSTPIDHVKSHNNNNHFKNSCFNNTDHYHHIQSSNNVVVEDLFGFGNHGQGENFRMGEWDLEGLMQDISYFPSLDFQV

SEQ ID NO: 49 - DNA, 933 bp, Glycine max
  Glyma13g27310.1
atgaggaaacctgatctgatggccaacaaggacaaagtgaacaacaacataaagagcaagttgagaaaagggttgtggtcaccagatgaagatgagaggctcataaggtacatgctcacaaatggacaagggtgttggagtgacattgctaggaatgctggtcttcaaaggtgtggcaaaagttgccgtcttcgttggatcaattacttgagacctgacctcaagcgtggtgcattttcgccccaagaggaagatctcatcgttcatttgcactccattcttggcaataggtggtctcagattgcagcacatctccctggccgcacagacaatgagattaagaatttctggaactccacattgaagaaaaggttgaaagcaaacacttctactccctcactaaacaacagcacaggctcatcagagtctaataaggatgttttgagtgggatcatgccctttagtgaacatgacatcatgaccatgtgcatggattcctcttcttccatatcatccatgcaagcaacggttttgcctgaccaatttgaccctttttccatgttggcaaataatcagtgtgacatgactaatgtttcagcagattttcccaacttgactcaaattggcatggtagaggggcatgaagggaattatgggatattggagccaaataaaatggggttaggaagagatttctcccttccttcactagaaagtagaagcattgaaagcaatagtgtcccaattgatgtgaaaagccataacaaccacttcaattatggttccttcaatcacactgataaaattcagggctccaaagtagaggacttaattgagtttggaaatcatggccaaggggaggatttaaaaatgggagagtgggatttggagaatttgatgcaagacataacctcttttcctttccttgagttt

SEQ ID NO: 50 - protein, 311 aa, Glycine max
  Glyma13g27310.1
MRKPDLMANKDKVNNNIKSKLRKGLWSPDEDERLIRYMLTNGQGCWSDIARNAGLQRCGKSCRLRWINYLRPDLKRGAFSPQEEDLIVHLHSILGNRWSQIAAHLPGRTDNEIKNFWNSTLKKRLKANTSTPSLNNSTGSSESNKDVLSGIMPFSEHDIMTMCMDSSSSISSMQATVLPDQFDPFSMLANNQCDMTNVSADFPNLTQIGMVEGHEGNYGILEPNKMGLGRDFSLPSLESRSIESNSVPIDVKSHNNHFNYGSFNHTDKIQGSKVEDLIEFGNHGQGEDLKMGEWDLENLMQDITSFPFLEF

SEQ ID NO: 51 - DNA, 945 bp, Glycine max
  Glyma12g36630.1
atgaggaaacctgatctgatggccaacaaggacaaaatgaacaacattaagagcaagttgagaaaagggttgtggtcaccagatgaagatgagaggctcgtaaggtacatgctgacaaatggacaagggtgttggagtgacattgctaggaatgctggtcttcaaaggtgtggcaaaagttgccgtcttcgttggatcaattacttgagacctgacctcaagcgtggtgcattctcacctcaagaggaagatctcatcgttcatttgcactccattcttggcaataggtggtctcagattgcagcgcgtctccctggccgcacagacaatgagattaagaatttctggaactccacattgaagaaaaggttgaaaactaacacttccactccctcactaaacaacagcactggctcatcagagtctaataaggatgttttgagtgggatcatgccctttaatgaacatgacatcatgaccatgtgcatggattcctcttcgtccatatcatccatgcaagcaatggttttgcctgaccaatttgacccttttttcatgttggcaaataatcagtgtgacatgactaatgtttcatctgacttttccaacatgcctgctgcatgcttgactcaaattggcatggtagatgggcatcaagggaattatgggatattggagccaaataaaatggggtcaggaatagacttctcccttccttcactagaaagtagaagcattgaaagcaatagtgtcccaattgatgtgaaaagccataacaaccacttcaattatggttccttcaagaacactgataagattcagggctccaaagtggaggacttgatcgggtttggaaatcatggccaaggggaaaatttaaaaatgggagagtgggatttggagaatttaatgcaagacataacctcttttcctttccttgatttt

SEQ ID NO: 52 - protein, 315 aa, Glycine max
  Glyma12g36630.1
MRKPDLMANKDKMNNIKSKLRKGLWSPDEDERLVRYMLTNGQGCWSDIARNAGLQRCGKSCRLRWINYLRPDLKRGAFSPQEEDLIVHLHSILGNRWSQIAARLPGRTDNEIKNFWNSTLKKRLKTNTSTPSLNNSTGSSESNKDVLSGIMPFNEHDIMTMCMDSSSSISSMQAMVLPDQFDPFFMLANNQCDMTNVSSDFSNMPAACLTQIGMVDGHQGNYGILEPNKMGSGIDFSLPSLESRSIESNSVPIDVKSHNNHFNYGSFKNTDKIQGSKVEDLIGFGNHGQGENLKMGEWDLENLMQDITSFPFLDF

SEQ ID NO: 53 - DNA, 1029 bp, Arabidopsis thaliana
  AT3G08500.1
atgatgatgaggaaaccggacattactacgatcagagacaaaggcaagccaaatcatgcatgtggtggtaataacaacaaaccgaagctaagaaaaggactttggtcgcctgatgaagatgagaagctgataagatacatgttgactaatggacaaggatgttggagtgacatcgctagaaatgctggtcttttacgttgtggtaaaagttgtcgccttcgctggatcaattacttgaggcctgatcttaaacgtggatccttctctcctcaggaggaggatctcatcttccatttgcattccattcttggtaacaggtggtctcaaatagctactcggcttccaggtagaacagacaacgagatcaaaaacttttggaactcgacattgaagaagcggcttaagaacaacagcaacaacaatacttcatcaggatcatcacctaacaatagtaatagtaattccttggacccaagagatcaacatgtggatatgggaggcaactcaacttcattgatggatgactatcatcatgatgaaaacatgatgacagtggggaacaccatgcgcatggactcttcctccccattcaatgttggaccaatggttaatagtgtgggcttaaaccaactttatgatcccttgatgatatcagtgccggataacggatatcaccaaatgggaaacacagtgaatgtgttcagcgttaatggtttaggagattatggaaacacaattcttgatccaattagcaagagagtatcagtagaaggtgatgattggttcattcccccctcggagaataccaacgtcattgcttgtagtacaagcaacaacctaaacttacaggcccttgatccttgcttcaatagcaaaaatctttgtcattcagaaagcttcaaggtagggaatgtgttggggatagagaatggttcttgggaaatagaaaaccctaaaatcggagattgggatttggatggtctcatcgataacaactcttcttttcccttccttgatttccaagtcgat

SEQ ID NO: 54 - protein, 343 aa, Arabidopsis thaliana
  AT3G08500.1
MMMRKPDITTIRDKGKPNHACGGNNNKPKLRKGLWSPDEDEKLIRYMLTNGQGCWSDIARNAGLLRCGKSCRLRWINYLRPDLKRGSFSPQEEDLIFHLHSILGNRWSQIATRLPGRTDNEIKNFWNSTLKKRLKNNSNNNTSSGSSPNNSNSNSLDPRDQHVDMGGNSTSLMDDYHHDENMMTVGNTMRMDSSSPFNVGPMVNSVGLNQLYDPLMISVPDNGYHQMGNTVNVFSVNGLGDYGNTILDPISKRVSVEGDDWFIPPSENTNVIACSTSNNLNLQALDPCFNSKNLCHSESFKVGNVLGIENGSWEIENPKIGDWDLDGLIDNNSSFPFLDFQVD

SEQ ID NO: 55 - DNA, 1215 bp, Zea mays
  GRMZM2G052606_T01
atgaggaaaccggagtgcccagcggcgaacagcagcaatgcgggggcggcggccgcgaagctgcggaaggggctgtggtcgccggaggaggacgagaggctggtggcgtacatgctgcggagtggacagggttcttggagcgatgtggcccggaacgccgggttgcagcggtgcggcaagagctgccgcctccggtggatcaactacctccggccggacctcaagcgcggcgccttctcgccgcaggaggaggagctcatcgtcagcctccacgccatcctgggaaacaggtggtctcagattgctgcccggttgccggggcgcaccgacaacgagatcaagaacttctggaactccaccatcaagaagcggctcaagaacagctcggcagcttcgtcaccagcagctacggactgcgcgtcgccggagcctaataacaaggtcgccgccgccggtagctgcccggatctttccgtcctagatcatcaggacggtggccaccaccacgcaatgacgacgacgactgcaggtttgtggatggtggactcatcctcctcttgtacctcgtcgacctcgccaatgcatcagtttcagaggccgacgacgacgatggcagcggccgtggccagcgggagctatggaggtctcgtccccttccctgaccaggtccgtggtgttgtggccgacacgggagggttctttcatggccacgcggcgccagcgttcaagcaccaagttgccgcattgcacggtggtggttattactacggcagcgctcctcgtcaccatggaatgacgacgacgacgacgacggtggcattggaaggaagcggtggatgcttcatatctggcgaaggcatgcttggtgtgccccctctgctgttagagcccatgtcagcagcgctagagcaagaccaaggccagaccttgatggcatcaagtggtaacaacaaccctaaaaacaacagcagcagcaacactactgatactacgactaccacgacactgagcaacaatgagagcaacgtcacagacaccaccaccaaggacaacaccaccaacaccatcagccaagtgaacagtggcagcaataatgtctactgggagggggcccgccagcagtacatgagcaggaatgtcatgcatggggagtgggacctggaggagctgatgaaagatgtgtcatccttgccttttcttgatttccaagttgaa

SEQ ID NO: 56 - protein, 405 aa, Zea mays
  GRMZM2G052606_T01
MRKPECPAANSSNAGAAAAKLRKGLWSPEEDERLVAYMLRSGQGSWSDVARNAGLQRCGKSCRLRWINYLRPDLKRGAFSPQEEELIVSLHAILGNRWSQIAARLPGRTDNEIKNFWNSTIKKRLKNSSAASSPAATDCASPEPNNKVAAAGSCPDLSVLDHQDGGHHHAMTTTTAGLWMVDSSSSCTSSTSPMHQFQRPTTTMAAAVASGSYGGLVPFPDQVRGVVADTGGFFHGHAAPAFKHQVAALHGGGYYYGSAPRHHGMTTTTTTVALEGSGGCFISGEGMLGVPPLLLEPMSAALEQDQGQTLMASSGNNNPKNNSSSNTTDTTTTTTLSNNESNVTDTTTKDNTTNTISQVNSGSNNVYWEGARQQYMSRNVMHGEWDLEELMKDVSSLPFLDFQVE

SEQ ID NO: 57 - DNA, 1236 bp, Setaria italica
  Si024786m
atgaggaagccggagggcccagcggcgagcggcggctgcaatggcggtgcggcggcggcggcgaagctgcggaaggggctgtggtcgccggaggaggacgagaagctggtggcctacatgctgcggagcgggcaggggtcgtggagcgacgtggcccggaacgccggcctgcaacgctgcggcaagagctgccgcctccggtggatcaactacctccggccggacctcaagcgcggcgccttctcgccgcaggaggaggacctcatcgtcagcctccacgccatcctcggcaacaggtggtctcagatcgctgcccggctgccggggcgcaccgacaacgagatcaagaacttctggaactccaccatcaagaagcggctcaagaacagctcctcggcctcgtcgccggcggccaccgactgcgcgtcgccgacggagcctagcagcaaggtcgccggcatcgacatcagcggcgccaccagctgcccggacctcgccggcctggaccatcatcatcaggacggcggccaccaccacgcgatgatgacgacgggcttgtggatggtggactcgtcctcctccacttcctcatcgacctcgccgatgcagagccggccgccgccgtcggccattgcagcggcggtggcccggagctacggcggcctcctccccctccccgaccagctccgcggcggcacggcggccgacacgtcgccggcagggttcttccacggccacgcggcgccgttcaaacagcaagcagcagttgcctcattgcatggcggttactatggaatgggcagtcctcatcaccatgggatgatggcaatggagggaggaggagggtgcttcatgagaggagaaggcctctttggtgtggcccctctgctggatgccatgtcagcacaagaccaagaccaggcaggccaggccctaatagcatcaagtggtggtaacaacaaccctaaaaacaacagcagcaacaacactaccgagactacaacaacagtgagtaacaatgagagcaacatcacagacaacaacaccaccaacaccaaggacaacaacatcaacgccatgagcctagtgaacagcggcagcagcaatgtggctgctgtctactgggagggggcccaccagcagtacatgagcaggaatgtcatgcatggggagtgggacctggaggagctgatgaaagatgtgtcatccttgcctttccttgatttccaagtcgaa

SEQ ID NO: 58 - protein, 412 aa, Setaria italica
  Si024786m
MRKPEGPAASGGCNGGAAAAAKLRKGLWSPEEDEKLVAYMLRSGQGSWSDVARNAGLQRCGKSCRLRWINYLRPDLKRGAFSPQEEDLIVSLHAILGNRWSQIAARLPGRTDNEIKNFWNSTIKKRLKNSSSASSPAATDCASPTEPSSKVAGIDISGATSCPDLAGLDHHHQDGGHHHAMMTTGLWMVDSSSSTSSSTSPMQSRPPPSAIAAAVARSYGGLLPLPDQLRGGTAADTSPAGFFHGHAAPFKQQAAVASLHGGYYGMGSPHHHGMMAMEGGGGCFMRGEGLFGVAPLLDAMSAQDQDQAGQALIASSGGNNNPKNNSSNNTTETTTTVSNNESNITDNNTTNTKDNNINAMSLVNSGSSNVAAVYWEGAHQQYMSRNVMHGEWDLEELMKDVSSLPFLDFQVE

SEQ ID NO: 59 - DNA, 1227 bp, Oryza sativa
  LOC_Os12g33070.1
atgaggaagccggattgcggcggcgggggaggggcggcgaagggcggcggcgttctgggtgtggcgggagggaacaatgcggcggtggtgggggggaaggttcggaaggggctgtggtcgccggaggaggacgagaagctggtggcgtacatgctgcggagcgggcaggggtcgtggagcgacgtggcgaggaacgccgggctgcagcgctgcggcaagagctgccgcctccggtggatcaactacctccgccccgacctcaagcgcggcgccttctcgccgcaggaggaggacctcatcgtcaacctccacgccatcctcggcaacaggtggtctcagatcgctgcccggctaccggggcgcaccgacaacgagatcaagaacttctggaactccaccatcaagaagcgcctcaagatctcctcctcctcggcgtctccggccaccaccaccgactgcgcctccccgccggagcacaagctcggcgccgtcgtcgacctcgccggcggcggcggcgccacggacgacgtcgttgtcgggacagctaatgctgccatgaagagcatgtgggtggattcctcgtcgtcgtcgtcgtcgtcttcctcgtcgatgcagagccggccgtcgataatggcggcggcggcggcggggaggagctacggcggcctcctcccactccccgaccaggtctgcggcgtcgacacctcgccgccaccgccgttcttccacgaccactccatctccatcaagcaagcatactacggatcaaccggcgcccaccaccaccaccacgcgatcgccaccatggacggatcaagcttaataggagatcatcaccatcacagcagcagcatcctctttggcggcgcatcagtgccacctctcctagaccaccaaaccattctcgacgacgacgacgaccaccctaacaaaaccggcagcaacacgaccgcggccacactgagcagcaacatcacagacaacagcaacagcaacaagaacaacagtgataataacaacaacatcagcagcagctgctgcattagcctaatgaacagcagcagcaacatgatctattgggagggtcaccaccaacaacagcagcagcagcatcagatgctgcagcagcagcagcagcacatgagcaggaatgtcatgggagagtgggacttggaggagctgatgaaagatgtgtcatccttgcctttccttgatttccaagttgaa

SEQ ID NO: 60 - protein, 409 aa, Oryza sativa
  LOC_Os12g33070.1
MRKPDCGGGGGAAKGGGVLGVAGGNNAAVVGGKVRKGLWSPEEDEKLVAYMLRSGQGSWSDVARNAGLQRCGKSCRLRWINYLRPDLKRGAFSPQEEDLIVNLHAILGNRWSQIAARLPGRTDNEIKNFWNSTIKKRLKISSSSASPATTTDCASPPEHKLGAVVDLAGGGGATDDVVVGTANAAMKSMWVDSSSSSSSSSSSMQSRPSIMAAAAAGRSYGGLLPLPDQVCGVDTSPPPPFFHDHSISIKQAYYGSTGAHHHHHAIATMDGSSLIGDHHHHSSSILFGGASVPPLLDHQTILDDDDDHPNKTGSNTTAATLSSNITDNSNSNKNNSDNNNNISSSCCISLMNSSSNMIYWEGHHQQQQQQHQMLQQQQQHMSRNVMGEWDLEELMKDVSSLPFLDFQVE

SEQ ID NO: 61 - protein, 61 aa, Arabidopsis thaliana
  AT5G52260.1 1st Myb Domain
WSPEEDQKLKSFILSRGHACWTTVPILAGLQRNGKSCRLRWINYLRPGLKRGSFSEEEEET

SEQ ID NO: 62 - protein, 61 aa, Arabidopsis thaliana
  AT4G25560.1 1st Myb Domain
WSPEEDEKLRSFILSYGHSCWTTVPIKAGLQRNGKSCRLRWINYLRPGLKRDMISAEEEET

SEQ ID NO: 63 - protein, 61 aa, Oryza sativa
  LOC_Os04g45020.1 1st Myb Domain
WSPEEDQKLRDFILRYGHGCWSAVPVKAGLQRNGKSCRLRWINYLRPGLKHGMFSREEEET

SEQ ID NO: 64 - protein, 61 aa, Brachypodium distachyon
  Bradi5g16672.1 1st Myb Domain
WSPEEDQKLRDYIIRYGHSCWSTVPVKAGLQRNGKSCRLRWINYLRPGLKHGMFSQEEEET

SEQ ID NO: 65 - protein, 61 aa, Zea mays
  GRMZM2G170049_T01 1st Myb Domain
WSPEEDQKLRDYILLHGHGCWSALPAKAGLQRNGKSCRLRWINYLRPGLKHGMFSPEEEET

SEQ ID NO: 66 - protein, 61 aa, Setaria italica
  Si012304m 1st Myb Domain
WSPEEDEKLRDFILRYGHGCWSALPAKAGLQRNGKSCRLRWINYLRPGLKHGMFSREEEET

SEQ ID NO: 67 - protein, 61 aa, Citrus clementina
  clementine0.9_033485m 1st Myb Domain
WSPEEDQRLKNYVLQHGHPCWSSVPINAGLQRNGKSCRLRWINYLRPGLKRGVFNMQEEET

SEQ ID NO: 68 - protein, 61 aa, Populus trichocarpa
  POPTR_0015s13190.1 1st Myb Domain
WSPEEDQRLRNYVLKHGHGCWSSVPINAGLQRNGKSCRLRWINYLRPGLKRGTFSAQEEET

SEQ ID NO: 69 - protein, 61 aa, Eucalyptus grandis
  EUCGR.K00250.1 1st Myb Domain
WSPEEDQKLRNYVLKHGHGCWSSVPINTGLQRNGKSCRLRWINYLRPGLKRGMFTMEEEEI

SEQ ID NO: 70 - protein, 61 aa, Eucalyptus grandis
  EUCGR.K00251.1 1st Myb Domain
WSPEEDQRLRNYILNHGHGYWSSVPINTGLQRNGKSCRLRWINYLRPGLKRGMFTLEEEEI

SEQ ID NO: 71 - protein, 61 aa, Populus trichocarpa
  POPTR_0012s13260.1 1st Myb Domain
WSPEEDQRLGSYVFQHGHGCWSSVPINAGLQRTGKSCRLRWINYLRPGLKRGAFSTDEEET

SEQ ID NO: 72 - protein, 61 aa, Glycine max
  Glyma16g31280.1 1st Myb Domain
WSPEEDNKLRNHIIKHGHGCWSSVPIKAGLQRNGKSCRLRWINYLRPGLKRGVFSKHEEDT

SEQ ID NO: 73 - protein, 61 aa, Glycine max
  Glyma09g25590.1 1st Myb Domain
WSPEEDNKLRNHIIKHGHGCWSSVPIKAGLQRNGKSCRLRWINYLRPGLKRGVFSKHEKDT

SEQ ID NO: 74 - protein, 61 aa, Solanum lycopersicum
  Solyc03g025870.2.1 1st Myb Domain
WSPDEDDRLKNYMIKHGHGCWSSVPINAGLQRNGKSCRLRWINYLRPGLKRGAFSLEEEDI

SEQ ID NO: 75 - protein, 61 aa, Vitis vinifera
  GSVIVT01028984001 1st Myb Domain
WSPEEDARLRNYVLKYGLGCWSSVPVNAGLQRNGKSCRLRWINYLRPGLKRGMFTIEEEET

SEQ ID NO: 76 - protein, 61 aa, Eucalyptus grandis
  EUCGR.A02796.1 1st Myb Domain
WSPDEDQRLRNYIHKHGYSCWSSVPINAGLQRNGKSCRLRWINYLRPGLKRGAFTVQEEET

SEQ ID NO: 77 - protein, 61 aa, Arabidopsis thaliana
  AT3G48920.1 1st Myb Domain
WSPEEDEKLRSHVLKYGHGCWSTIPLQAGLQRNGKSCRLRWVNYLRPGLKKSLFTKQEETI

SEQ ID NO: 78 - protein, 46 aa, Arabidopsis thaliana
  AT5G52260.1 SANT1 domain
LWSPEEDQKLKSFILSRGHACWTTVPILAGLQRNGKSCRLRWINYL

SEQ ID NO: 79 - protein, 46 aa, Arabidopsis thaliana
  AT4G25560.1 SANT1 domain
LWSPEEDEKLRSFILSYGHSCWTTVPIKAGLQRNGKSCRLRWINYL

SEQ ID NO: 80 - protein, 46 aa, Oryza sativa
  LOC_Os04g45020.1 SANT1 domain
LWSPEEDQKLRDFILRYGHGCWSAVPVKAGLQRNGKSCRLRWINYL

SEQ ID NO: 81 - protein, 46 aa, Brachypodium distachyon
  Bradi5g16672.1 SANT1 domain
LWSPEEDQKLRDYIIRYGHSCWSTVPVKAGLQRNGKSCRLRWINYL

SEQ ID NO: 82 - protein, 46 aa, Zea mays
  GRMZM2G170049_T01 SANT1 domain
LWSPEEDQKLRDYILLHGHGCWSALPAKAGLQRNGKSCRLRWINYL

SEQ ID NO: 83 - protein, 46 aa, Setaria italica
  Si012304m SANT1 domain
LWSPEEDEKLRDFILRYGHGCWSALPAKAGLQRNGKSCRLRWINYL

SEQ ID NO: 84 - protein, 46 aa, Citrus clementina
  clementine0.9_033485m SANT1 domain
LWSPEEDQRLKNYVLQHGHPCWSSVPINAGLQRNGKSCRLRWINYL

SEQ ID NO: 85 - protein, 46 aa, Populus trichocarpa
  POPTR_0015s13190.1 SANT1 domain
LWSPEEDQRLRNYVLKHGHGCWSSVPINAGLQRNGKSCRLRWINYL

SEQ ID NO: 86 - protein, 46 aa, Eucalyptus grandis
  Eucgr.K00250.1 SANT1 domain
LWSPEEDQKLRNYVLKHGHGCWSSVPINTGLQRNGKSCRLRWINYL

SEQ ID NO: 87 - protein, 46 aa, Eucalyptus grandis
  Eucgr.K00251.1 SANT1 domain
LWSPEEDQRLRNYILNHGHGYWSSVPINTGLQRNGKSCRLRWINYL

SEQ ID NO: 88 - protein, 46 aa, Populus trichocarpa
  POPTR_0012s13260.1 SANT1 domain
LWSPEEDQRLGSYVFQHGHGCWSSVPINAGLQRTGKSCRLRWINYL

SEQ ID NO: 89 - protein, 46 aa, Glycine max
  Glyma16g31280.1 SANT1 domain
LWSPEEDNKLRNHIIKHGHGCWSSVPIKAGLQRNGKSCRLRWINYL

SEQ ID NO: 90 - protein, 46 aa, Glycine max; identical to SEQ ID NO: 89
  Glyma09g25590.1 SANT1 domain

SEQ ID NO: 91 - protein, 46 aa, Solanum lycopersicum
  Solyc03g025870.2.1 SANT1 domain
LWSPDEDDRLKNYMIKHGHGCWSSVPINAGLQRNGKSCRLRWINYL

SEQ ID NO: 92 - protein, 46 aa, Vitis vinifera
  GSVIVT01028984001 SANT1 domain
LWSPEEDARLRNYVLKYGLGCWSSVPVNAGLQRNGKSCRLRWINYL

SEQ ID NO: 93 - protein, 46 aa, Eucalyptus grandis
  Eucgr.A02796.1 SANT1 domain
LWSPDEDQRLRNYIHKHGYSCWSSVPINAGLQRNGKSCRLRWINYL

SEQ ID NO: 94 - protein, 46 aa, Arabidopsis thaliana
  AT3G48920.1 SANT1 domain
LWSPEEDEKLRSHVLKYGHGCWSTIPLQAGLQRNGKSCRLRWVNYL

SEQ ID NO: 95 - protein, 43 aa, Arabidopsis thaliana
  AT5G52260.1 2nd Myb Domain
FSEEEEETILTLHSSLGNKWSRIAKYLPGRTDNEIKNYWHSYL

SEQ ID NO: 96 - protein, 43 aa, Arabidopsis thaliana
  AT4G25560.1 2nd Myb Domain
ISAEEEETILTFHSSLGNKWSQIAKFLPGRTDNEIKNYWHSHL

SEQ ID NO: 97 - protein, 43 aa, Oryza sativa
  LOC_Os04g45020.1 2nd Myb Domain
FSREEEETVMNLHATMGNKWSQIARHLPGRTDNEVKNYWNSYL

SEQ ID NO: 98 - protein, 43 aa, Brachypodium distachyon
  Bradi5g16672.1 2nd Myb Domain
FSQEEEETVMSLHATLGNKWSRIAQHLPGRTDNEVKNYWNSYL

SEQ ID NO: 99 - protein, 43 aa, Zea mays
  GRMZM2G170049_T01 2nd Myb Domain
FSPEEEETVMSLHATLGNKWSRIARHLPGRTDNEVKNYWNSYL

SEQ ID NO: 100 - protein, 43 aa, Setaria italica
  Si012304m 2nd Myb Domain
FSREEEETVMSLHAKLGNKWSQIARHLPGRTDNEVKNYWNSYL

SEQ ID NO: 101 - protein, 43 aa, Citrus clementina
  clementine0.9_033485m 2nd Myb Domain
FNMQEEETILTVHRLLGNKWSQIAQHLPGRTDNEIKNYWHSHL

SEQ ID NO: 102 - protein, 43 aa, Populus trichocarpa
  POPTR_0015s13190.1 2nd Myb Domain
FSAQEEETILALHHMLGNKWSQIAQHLPGRTDNEIKNHWHSYL

SEQ ID NO: 103 - protein, 43 aa, Eucalyptus grandis
  EUCGR.K00250.1 2nd Myb Domain
FTMEEEEIIFSLHHLIGNKWSQIAKHLPGRTDNEIKNHWHSYL

SEQ ID NO: 104 - protein, 43 aa, Eucalyptus grandis
  EUCGR.K00251.1 2nd Myb Domain
FTLEEEEIILSLHRLIGNKWSQIAKHLPGRTDNEIKNHWHSYL

SEQ ID NO: 105 - protein, 43 aa, Populus trichocarpa
  POPTR_0012s13260.1 2nd Myb Domain
FSTDEEETILTLHRMLGNKWSQIAQHLPGRTDNEIKNHWHSYL

SEQ ID NO: 106 - protein, 43 aa, Glycine max
  Glyma16g31280.1 2nd Myb Domain
FSKHEEDTIMVLHHMLGNKWSQIAQHLPGRTDNEIKNYWHSYL

SEQ ID NO: 107 - protein, 43 aa, Glycine max
  Glyma09g25590.1 2nd Myb Domain
FSKHEKDTIMALHHMLGNKWSQIAQHLPGRTDNEVKNYWHSYL

SEQ ID NO: 108 - protein, 43 aa, Solanum lycopersicum
  Solyc03g025870.2.1 2nd Myb Domain
FSLEEEDIILTLHAMFGNKWSQIAQQLPGRTDNEIKNHWHSYL

SEQ ID NO: 109 - protein, 43 aa, Vitis vinifera
  GSVIVT01028984001 2nd Myb Domain
FTIEEEETIMALHRLLGNKWSQIAQNFPGRTDNEIKNYWHSCL

SEQ ID NO: 110 - protein, 43 aa, Eucalyptus grandis
  EUCGR.A02796.1 2nd Myb Domain
FTVQEEETILNLHHLLGNKWSQIAQHLPGRTDNEIKNHWHSYL

SEQ ID NO: 111 - protein, 43 aa, Arabidopsis thaliana
  AT3G48920.1 2nd Myb Domain
FTKQEETILLSLHSMLGNKWSQISKFLPGRTDNEIKNYWHSNL

SEQ ID NO: 112 - protein, 44 aa, Arabidopsis thaliana
  AT4G25560.1 SANT2 domain
MISAEEEETILTFHSSLGNKWSQIAKFLPGRTDNEIKNYWHSHL

SEQ ID NO: 113 - protein, 44 aa, Arabidopsis thaliana
  AT5G52260.1 SANT2 domain
SFSEEEEETILTLHSSLGNKWSRIAKYLPGRTDNEIKNYWHSYL

SEQ ID NO: 114 - protein, 44 aa, Oryza sativa
  LOC_Os04g45020.1 SANT2 domain
MFSREEEETVMNLHATMGNKWSQIARHLPGRTDNEVKNYWNSYL

SEQ ID NO: 115 - protein, 44 aa, Brachypodium distachyon
  Bradi5g16672.1 SANT2 domain
MFSQEEEETVMSLHATLGNKWSRIAQHLPGRTDNEVKNYWNSYL

SEQ ID NO: 116 - protein, 44 aa, Zea mays
  GRMZM2G170049_T01 SANT2 domain
MFSPEEEETVMSLHATLGNKWSRIARHLPGRTDNEVKNYWNSYL

SEQ ID NO: 117 - protein, 44 aa, Setaria italica
  Si012304m SANT2 domain
MFSREEEETVMSLHAKLGNKWSQIARHLPGRTDNEVKNYWNSYL

SEQ ID NO: 118 - protein, 44 aa, Citrus clementina
  clementine0.9_033485m SANT2 domain
VFNMQEEETILTVHRLLGNKWSQIAQHLPGRTDNEIKNYWHSHL

SEQ ID NO: 119 - protein, 44 aa, Populus trichocarpa
  POPTR_0015s13190.1 SANT2 domain
TFSAQEEETILALHHMLGNKWSQIAQHLPGRTDNEIKNHWHSYL

SEQ ID NO: 120 - protein, 44 aa, Eucalyptus grandis
  Eucgr.K00250.1 SANT2 domain
MFTMEEEEIIFSLHHLIGNKWSQIAKHLPGRTDNEIKNHWHSYL

SEQ ID NO: 121 - protein, 44 aa, Eucalyptus grandis
  Eucgr.K00251.1 SANT2 domain
MFTLEEEEIILSLHRLIGNKWSQIAKHLPGRTDNEIKNHWHSYL

SEQ ID NO: 122 - protein, 44 aa, Populus trichocarpa
  POPTR_0012s13260.1 SANT2 domain
AFSTDEEETILTLHRMLGNKWSQIAQHLPGRTDNEIKNHWHSYL

SEQ ID NO: 123 - protein, 44 aa, Glycine max
  Glyma16g31280.1 SANT2 domain
VFSKHEEDTIMVLHHMLGNKWSQIAQHLPGRTDNEIKNYWHSYL

SEQ ID NO: 124 - protein, 44 aa, Glycine max
  Glyma09g25590.1 SANT2 domain
VFSKHEKDTIMALHHMLGNKWSQIAQHLPGRTDNEVKNYWHSYL

SEQ ID NO: 125 - protein, 44 aa, Solanum lycopersicum
  Solyc03g025870.2.1 SANT2 domain
AFSLEEEDIILTLHAMFGNKWSQIAQQLPGRTDNEIKNHWHSYL

SEQ ID NO: 126 - protein, 44 aa, Vitis vinifera
  GSVIVT01028984001 SANT2 domain
MFTIEEEETIMALHRLLGNKWSQIAQNFPGRTDNEIKNYWHSCL

SEQ ID NO: 127 - protein, 44 aa, Eucalyptus grandis
  Eucgr.A02796.1 SANT2 domain
AFTVQEEETILNLHHLLGNKWSQIAQHLPGRTDNEIKNHWHSYL

SEQ ID NO: 128 - protein, 44 aa, Arabidopsis thaliana
  AT3G48920.1 SANT2 domain
LFTKQEETILLSLHSMLGNKWSQISKFLPGRTDNEIKNYWHSNL

SEQ ID NO: 129 - protein, 58 aa, Arabidopsis thaliana
  misc_feature (4)..(4): Xaa is Asp or Glu
  misc_feature (7)..(8): Xaa can be any naturally occurring amino acid
  misc_feature (10)..(12): Xaa can be any naturally occurring amino acid
  misc_feature (13)..(13): Xaa is Ile, Val, Leu or Met
  misc_feature (14)..(16): Xaa can be any naturally occurring amino acid
  misc_feature (18)..(20): Xaa can be any naturally occurring amino acid
  misc_feature (22)..(22): Xaa is Ser or Thr
  misc_feature (23)..(23): Xaa can be any naturally occurring amino acid
  misc_feature (24)..(24): Xaa is Ile, Val, Leu or Met
  misc_feature (26)..(28): Xaa can be any naturally occurring amino acid
  misc_feature (33)..(33): Xaa can be any naturally occurring amino acid
  misc_feature (42)..(42): Xaa is Ile, Val, Leu or Met
  misc_feature (51)..(57): Xaa can be any naturally occurring amino acid
  AtMYB19 clade DNA binding domain 1 consensus sequence
WSPXEDXXLXXXXXXXGXXXWXXXPXXXGLQRXGKSCRLRWXNYLRPGLKXXXXXXXE

SEQ ID NO: 130 - protein, 39 aa, Arabidopsis thaliana
  misc_feature (2)..(4): Xaa can be any naturally occurring amino acid
  misc_feature (5)..(5): Xaa is Ile, Val, Leu, or Met
  misc_feature (6)..(8): Xaa can be any naturally occurring amino acid
  misc_feature (10)..(12): Xaa can be any naturally occurring amino acid
  misc_feature (18)..(18): Xaa can be any naturally occurring amino acid
  misc_feature (20)..(20): Xaa is Ala or Ser
  misc_feature (21)..(23): Xaa can be any naturally occurring amino acid
  misc_feature (31)..(31): Xaa is Ile, Val, Leu, or Met
  misc_feature (34)..(34): Xaa can be any naturally occurring amino acid
  misc_feature (36)..(36): Xaa can be any naturally occurring amino acid
  misc_feature (38)..(38): Xaa can be any naturally occurring amino acid
  AtMYB19 clade DNA binding domain 2 consensus sequence
EXXXXXXXHXXXGNKWSXIXXXXPGRTDNEXKNXWXSXL

SEQ ID NO: 131 - protein, 46 aa, Arabidopsis thaliana
  misc_feature (5)..(5): Xaa can be any naturally occurring amino acid
  misc_feature (8)..(9): Xaa can be any naturally occurring amino acid
  misc_feature (11)..(17): Xaa can be any naturally occurring amino acid
  misc_feature (19)..(21): Xaa can be any naturally occurring amino acid
  misc_feature (23)..(25): Xaa can be any naturally occurring amino acid
  misc_feature (27)..(29): Xaa can be any naturally occurring amino acid
  misc_feature (34)..(34): Xaa can be any naturally occurring amino acid
  misc_feature (43)..(43): Xaa can be any naturally occurring amino acid
  AtMYB19 clade SANT 1 Consensus
LWSPXEDXXLXXXXXXXGXXXWXXXPXXXGLQRXGKSCRLRWXNYL

SEQ ID NO: 132 - protein, 39 aa, Arabidopsis thaliana; identical to SEQ ID NO: 130
  misc_feature (2)..(8): Xaa can be any naturally occurring amino acid
  misc_feature (10)..(12): Xaa can be any naturally occurring amino acid
  misc_feature (18)..(18): Xaa can be any naturally occurring amino acid
  misc_feature (20)..(23): Xaa can be any naturally occurring amino acid
  misc_feature (31)..(31): Xaa can be any naturally occurring amino acid
  misc_feature (34)..(34): Xaa can be any naturally occurring amino acid
  misc_feature (36)..(36): Xaa can be any naturally occurring amino acid
  misc_feature (38)..(38): Xaa can be any naturally occurring amino acid
  AtMYB19 clade SANT 2 Consensus

SEQ ID NO: 133 - protein, 6 aa, Arabidopsis thaliana
  misc_feature (2)..(2): Xaa can be any naturally occurring amino acid
  misc_feature (4)..(4): Xaa can be any naturally occurring amino acid
  misc_feature (5)..(5): Xaa is Asp or Glu
  small motif found in AtMYB19 clade
PXFXXW

SEQ ID NO: 134 - DNA, 942 bp, Arabidopsis thaliana
  AtMYB50 (AT1G57560.1 or G1319)
atgaagagacattcttgttgttacaaacaaaagctgagaaaaggtctttggtctcctgaagaagatgagaaacttctcaattacattaccaaacatggccatggttgctggagttctgtccctaaactcgcaggtctcgagagatgtggaaagagctgtagactcagatggatcaattacttaagacctgatttaaagagaggagctttctcttcagaggaacagaatctcattgtcgagcttcatgctgttcttggaaacagatggtcgcaaattgctgcgaggcttcccgggagaaccgacaacgagataaagaacttgtggaattcgtgcattaagaagaagctgatgaagaaaggcattgaccctattacacataaacccctctccgaggttggtaaagaaacaaacagaagcgacaataacaattccacaagtttttcctcagaaactaatcaagacttgtttgtcaagaaaacgtctgattttgccgagtattctgcgtttcagaaagaagaatccaactctgtttcactcagaaattcgctctcttccatgatcccaacgcaattcaacatcgacgatggttctgtctcaaatgcgggttttgatacacaagtatgcgtgaaaccctcgattattcttcttcctcctccaaacaacacttcaagcactgtctctggacaggatcatgtaaacgtgtcagagcctaattgggaatcaaacagtggaaccacaagccacctcaacaatcccggtatggaagaaatgaaatggtccgaggagtacctaaacgaatcgttattctctacccaagtttacgtgaaatcagagacggatttcaactccaacattgcctttccttggagccaaagccaagcttgtgacgtattccccaaggatcttcagagaatggccttctcttttggtggtcagaccctt

SEQ ID NO: 135 - protein, 314 aa, Arabidopsis thaliana
  AtMYB50 (AT1G57560 or G1319) polypeptide
MKRHSCCYKQKLRKGLWSPEEDEKLLNYITKHGHGCWSSVPKLAGLERCGKSCRLRWINYLRPDLKRGAFSSEEQNLIVELHAVLGNRWSQIAARLPGRTDNEIKNLWNSCIKKKLMKKGIDPITHKPLSEVGKETNRSDNNNSTSFSSETNQDLFVKKTSDFAEYSAFQKEESNSVSLRNSLSSMIPTQFNIDDGSVSNAGFDTQVCVKPSIILLPPPNNTSSTVSGQDHVNVSEPNWESNSGTTSHLNNPGMEEMKWSEEYLNESLFSTQVYVKSETDFNSNIAFPWSQSQACDVFPKDLQRMAFSFGGQTL

SEQ ID NO: 136 - DNA, 1098 bp, Arabidopsis thaliana
  AT1G09540.1
atggggagacattcttgctgttacaaacaaaagctgaggaaagggctttggtctcctgaagaagacgagaagcttcttactcacatcaccaatcacggccatggctgctggagctctgtccctaaactcgctggtttgcagagatgtgggaagagttgtcgactaagatggatcaattacttgagacctgatttaaagagaggagctttttctcctgaagaagagaatctcatcgtcgaacttcatgccgtccttggaaacagatggtcacagattgcgtcaaggcttccgggtagaaccgacaacgagatcaagaatctatggaactcaagcatcaagaagaaactgaaacaaagaggcattgacccaaacacacacaagcccatctctgaagttgagagttttagcgacaaagacaaaccaacaacaagcaacaacaaaagaagcggtaacgatcacaagtctcctagttcctcttctgcgactaaccaagacttcttcctcgaaaggccatctgatttatccgactacttcggatttcagaagcttaacttcaactccaatctaggactctctgttacaactgattcttcactctgctcgatgattccgccgcagtttagccccgggaacatggttggttctgtccttcagacaccagtatgcgtaaagccctcgattagtcttcctcccgacaacaacagttcgagtcctatctccggaggagatcatgtgaaattggctgcaccaaactgggaatttcagacaaacaacaataatacctcaaatttcttcgacaatggcggattctcatggtctatcccaaattcttctacttcttcttcacaagtcaaaccaaatcataacttcgaagaaataaaatggtcagagtatttgaacacaccgttcttcatagggagtactgtacagagtcaaacctctcaaccaatctacatcaaatcagaaacagattacttagccaatgtttcaaacatgacagatccttggagccaaaacgagaacttgggcacaactgaaactagtgacgtgttctccaaggatcttcagagaatggccgtctcttttggtcagtccctt

SEQ ID NO: 137 - protein, 366 aa, Arabidopsis thaliana
  AT1G09540.1 polypeptide
MGRHSCCYKQKLRKGLWSPEEDEKLLTHITNHGHGCWSSVPKLAGLQRCGKSCRLRWINYLRPDLKRGAFSPEEENLIVELHAVLGNRWSQIASRLPGRTDNEIKNLWNSSIKKKLKQRGIDPNTHKPISEVESFSDKDKPTTSNNKRSGNDHKSPSSSSATNQDFFLERPSDLSDYFGFQKLNFNSNLGLSVTTDSSLCSMIPPQFSPGNMVGSVLQTPVCVKPSISLPPDNNSSSPISGGDHVKLAAPNWEFQTNNNNTSNFFDNGGFSWSIPNSSTSSSQVKPNHNFEEIKWSEYLNTPFFIGSTVQSQTSQPIYIKSETDYLANVSNMTDPWSQNENLGTTETSDVFSKDLQRMAVSFGQSL

SEQ ID NO: 138 - DNA, 1056 bp, Arabidopsis thaliana
  AT5G26660.1
atgggaagacattcttgttgttttaagcagaagctaagaaaaggcctttggtctcctgaagaagatgagaaacttctcaattacatcactagacatggtcatggctgttggagttctgtccctaaactcgcaggtttgcaaagatgtggaaagagttgtagacttaggtggataaattatttgagaccagatttaaagagaggagctttctctcaagacgaagaaagcttgatcattgagctccatgctgcattaggcaacagatggtctcaaatcgcaacgcggttaccgggaagaacagacaacgagatcaaaaacttttggaactcatgtcttaagaagaagctgagaagaaaaggcattgacccaacaacacataaacccttaataacaaacgagcttcaatctcttaacgtcatagatcagaaactgacgtcatcagaagtagtaaagtcaacgggttcgataaacaacctacatgatcagtcaatggtcgtctcatcgcaacaaggtccatggtggttcccggcgaatacaactacgactaatcaaaactctgcgttttgctttagttcaagtaatactacaacggtttcagaccagatcgtatctttaatctcttcaatgtctacgtcatcatctccgacaccaatgacttcaaacttcagtcctgctccaaacaactgggaacaactcaactactgcaacacagtaccaagtcagagcaacagtatctacagtgccttctttggtaatcaatacacagaagctagccaaaccatgaacaataataatccactagtagatcaacatcatcatcatcaagacatgaagtcatgggcatcagagattcttcattacacagaacacaaccaaagctcagaaactgttatagaagcagaagtgaagccagacattgccaactactactggagatcagcatcatcatcgtcgtcaccaaaccaagaagctgcaacattactacacgatgctaacgtggaagtgtacggtaaaaatctacaaaagcttaataacatggtgtttgatcagagcctt

SEQ ID NO: 139 - protein, 352 aa, Arabidopsis thaliana
  AT5G26660.1 polypeptide
MGRHSCCFKQKLRKGLWSPEEDEKLLNYITRHGHGCWSSVPKLAGLQRCGKSCRLRWINYLRPDLKRGAFSQDEESLIIELHAALGNRWSQIATRLPGRTDNEIKNFWNSCLKKKLRRKGIDPTTHKPLITNELQSLNVIDQKLTSSEVVKSTGSINNLHDQSMVVSSQQGPWWFPANTTTTNQNSAFCFSSSNTTTVSDQIVSLISSMSTSSSPTPMTSNFSPAPNNWEQLNYCNTVPSQSNSIYSAFFGNQYTEASQTMNNNNPLVDQHHHHQDMKSWASEILHYTEHNQSSETVIEAEVKPDIANYYWRSASSSSSPNQEAATLLHDANVEVYGKNLQKLNNMVFDQSL

SEQ ID NO: 140 - DNA, 1287 bp, Glycine max
  Glyma10g28250.1
atgggaagacactcttgttgctacaaacagaagttacggaaaggcctttggtctccagaggaagacgagaagcttctcaatcacatcaccaaacatggtcatggatgttggagctcggttcccaaactagctggtttgcagagatgtgggaagagctgcaggttgaggtggataaattatctaaggcctgatttgaagagaggagcattctcacagcaagaagagaacatgattgttgaacttcatgcagttcttggaaacaggtggtctcagattgcagcacagttaccaggaagaacagacaatgagattaagaacctatggaactcgtgcctgaagaagaagctgaggcaaagaggcattgacccaaccacacacaagccactctctgaggttgagaacgacaaggacatgaatatgatgccaccctcaaccgacaaaagcactcagaaagcctctgtgggatccaatgaagtagtgagtaatttggttgatcatcatcagccaccaaaaaccatgcctaattcttcatcagagagataccctcttgaagtttccactactagttccacccaggaactgttcctagataggtttggcaccaccaccaccacctgccacgaaaacaacaacaacacttctgatttggtaggatcatacttctccttccagcacttgaactatggaacaacaacaagcatggccctctcttcaaaccccaacacctctctttgtttcattctaccctccacttcttcagacattaataataacaactccatcataacctcctcctccatgctcccttcaattttcccaacacaacatgtgaagctccaatctaataacaacaacccttcttccatttcatctgatggggttcaaaactgggaaacaagtaacaacacaaacaaaaacaatgggaatatgcagttacaaagtagcacaaactaccttgacagcacgtggggggtggcagagtctatgaagattgttaacattaacaaagaggctcaagtagtgcctctacaagcagaacaagaagatctaaaatggtctgagtatcttaacaccccgtttattctgggaaacaacacaacgcagaatcatcaaattcaaacctctcaatctatctacactgaggttattaaaccagaaacaggtttcataatagacgagtcatgtactagtaattggcaccatcatcagccaccaccagcttttcaactttccgatatatatagcaaggatctgcagagattttcagtgactttcggacaaaccctg

SEQ ID NO: 141 - protein, 429 aa, Glycine max
  Glyma10g28250.1 polypeptide
MGRHSCCYKQKLRKGLWSPEEDEKLLNHITKHGHGCWSSVPKLAGLQRCGKSCRLRWINYLRPDLKRGAFSQQEENMIVELHAVLGNRWSQIAAQLPGRTDNEIKNLWNSCLKKKLRQRGIDPTTHKPLSEVENDKDMNMMPPSTDKSTQKASVGSNEVVSNLVDHHQPPKTMPNSSSERYPLEVSTTSSTQELFLDRFGTTTTTCHENNNNTSDLVGSYFSFQHLNYGTTTSMALSSNPNTSLCFILPSTSSDINNNNSIITSSSMLPSIFPTQHVKLQSNNNNPSSISSDGVQNWETSNNTNKNNGNMQLQSSTNYLDSTWGVAESMKIVNINKEAQVVPLQAEQEDLKWSEYLNTPFILGNNTTQNHQIQTSQSIYTEVIKPETGFIIDESCTSNWHHHQPPPAFQLSDIYSKDLQRFSVTFGQTL

SEQ ID NO: 142 - DNA, 1323 bp, Populus trichocarpa
  POPTR_0005s00340.1
atggggaggcattcttgctgttacaagcagaagttaagaaaaggcctgtggtctcctgaggaagatgagaaacttctgaattatattactaagcatggacatggctgttggagctctgtccctaaacaagcagatttgcagaggtgtggaaagagctgcaggttaagatggattaactacttgaggcctgatttgaagagaggagcattttcacagcaggaagaaaacttgataattgaactccatgcagttcttggcaatagatggtctcagattgcagcacagttacctggaagaactgataatgagataaagaatttatggaactcctgcattaagaagaagctgaggcagagaggcattgaccccaacactcacaaacctctctctgaagttgagaattgtaaagagaagcagcagcctacagctgacaagagcaatgagaaagtttctaatgtatcaaatgaactgaacctcattgaggcagctactttacaaccacctgcaatttcttccagctcaaagatcaacaacagtaaggacaggaatagtagtagcagcaacatgacaaatacaccaccgacaaaggaattcttcctggataggtttggtacctcccatgaaagctcccctgccagttgcaggccttctgatttgatggggtattttcctttccagaagttggattacaaacctagtataggcctctcaatgaatccaaataccactctctgcttcaatccaaattcctcttctgagatgatttctcatgagttcaattcttgtatgacaccaccgactattctcccatctgtttcaacctctatgttccaaactccaatacgtgtaaagccttctgttagtcttccatctgatcataatccttctgtaggctcttgtgatgtcaatggggttcagaactgggaagcaagtagcttcagcaacaatggaagtggaagcaatggaagcagtagcagtattgaattgcaaagcaacaccaatttctacgagagcagcgctttctcatgggggttagctaattgtgggaaatccggcgaggaatctcaccttcggtcactcgaaaacgacacagctgaagacatcaaatggtctgaatatcttaacaccacattctttcttggaagcacaatacaaaaccaaacatctcaacatgtgtacagtgaagtgaaaccagaaacacacttcatagcagaagggtcaagtgctagttggataccgaaccagcatcaacaagcttcacagccagcagacatctataccaaggatctgcaaagacttgctgtggcttttggacaatccctt

SEQ ID NO: 143 - protein, 441 aa, Populus trichocarpa
  POPTR_0005s00340.1 polypeptide
MGRHSCCYKQKLRKGLWSPEEDEKLLNYITKHGHGCWSSVPKQADLQRCGKSCRLRWINYLRPDLKRGAFSQQEENLIIELHAVLGNRWSQIAAQLPGRTDNEIKNLWNSCIKKKLRQRGIDPNTHKPLSEVENCKEKQQPTADKSNEKVSNVSNELNLIEAATLQPPAISSSSKINNSKDRNSSSSNMTNTPPTKEFFLDRFGTSHESSPASCRPSDLMGYFPFQKLDYKPSIGLSMNPNTTLCFNPNSSSEMISHEFNSCMTPPTILPSVSTSMFQTPIRVKPSVSLPSDHNPSVGSCDVNGVQNWEASSFSNNGSGSNGSSSSIELQSNTNFYESSAFSWGLANCGKSGEESHLRSLENDTAEDIKWSEYLNTTFFLGSTIQNQTSQHVYSEVKPETHFIAEGSSASWIPNQHQQASQPADIYTKDLQRLAVAFGQSL

SEQ ID NO: 144 - DNA, 1374 bp, Citrus clementina
  clementine0.9_009770m
atggggaggcattcttgttgttacaagcagaagctgaggaaaggcttgtggtctcctgaggaagatgagaagctcctgaattatatcactaagcacggccatggctgctggagttctgtccctaaattagccggtaaaatttatttagaaaataacaatcatgcttgctctgttattttaatgttcaatgcatttaacacaatgtttttacttgcaggccttcaaagatgtggcaaaagctgcagattaagatggattaattaccttaggcctgatttgaagagaggagcattttccgtacaggaagagagtttgattgttgagctccatgcagtgcttggcaacagatggtctcagattgcagctcagttaccgggaagaactgataatgagataaagaatctatggaattcaagcattaagaagaagctgaggcaaaggggcattgaccccaatactcacaagccgctttctgaggttgaaaacgataaagaacagcagctcacggtcatcaacaagaacagtgacaaagcctctgcagaatcatcaaaagacttggctgctgaaataatgcacccacttgaagtctcttcgagctctgagatcaacactaacaataataataatgccagcatgttaaatttggtagataagtttgctgcagctgcttctaacaacgaaagctcaaccacaagttgtaggcctgatttgatgggatattttccctttcagaagttgaattatggccccaatattggtctctcagttaacacaaacacttcttctctttttttcaatccgaattccacctcttctgagatgatttctgagtttaattccagcataatcccttctatttcggcatcagtcttccaaactccaattcgcgtaaagccttctattagtcttccttccgagaatccttctgtaggcactagtgacatcaatggaatacaaaactgggaacctagtagctttagcaacaattgcagcaccagcaatggaagcacaacaagtattgaactgcagagcagcagtagcttctttgaaggcaacgtcttctcttggggaataactgcagattgtggcaaatctaatgatcaagaagctcaaattcgcgcattagaaggcgatcaagaagatatcaaatggtctgagtacctcaacactccattctttcttggaagcacaatacaaaatcatcaaacctctcagtctatgtacagtgatgttaaaccagaagcacattttatatcagaaggctcaaacaccaccacttggattcaaaaccagcatcaacaagcttcacaaactacaccagcaatgtatacaaaggacttacaaagactttctgtggcttttggacaaaccctt

SEQ ID NO: 145 - protein, 458 aa, Citrus clementina
  clementine0.9_009770m polypeptide
MGRHSCCYKQKLRKGLWSPEEDEKLLNYITKHGHGCWSSVPKLAGKIYLENNNHACSVILMFNAFNTMFLLAGLQRCGKSCRLRWINYLRPDLKRGAFSVQEESLIVELHAVLGNRWSQIAAQLPGRTDNEIKNLWNSSIKKKLRQRGIDPNTHKPLSEVENDKEQQLTVINKNSDKASAESSKDLAAEIMHPLEVSSSSEINTNNNNNASMLNLVDKFAAAASNNESSTTSCRPDLMGYFPFQKLNYGPNIGLSVNTNTSSLFFNPNSTSSEMISEFNSSIIPSISASVFQTPIRVKPSISLPSENPSVGTSDINGIQNWEPSSFSNNCSTSNGSTTSIELQSSSSFFEGNVFSWGITADCGKSNDQEAQIRALEGDQEDIKWSEYLNTPFFLGSTIQNHQTSQSMYSDVKPEAHFISEGSNTTTWIQNQHQQASQTTPAMYTKDLQRLSVAFGQTL

SEQ ID NO: 146 - DNA, 1284 bp, Glycine max
  Glyma20g22230.1
atgggaagacactcttgttgctacaaacagaagttacggaaaggcctttggtctccagaggaagacgagaagctgctgaattacatcaccaaacatggtcatggatgttggagctcggttcccaaactagctggtttgcagagatgtggcaagagctgcaggttgaggtggataaattacctgaggcctgatttgaagagaggagcattctcacaacaggaagaaaacatgattgttgaacttcatgcagttcttggaaacaggtggtctcagattgcagcacagttaccaggaagaacagacaatgagattaagaacctatggaactcttgcctgaagaagaagctgaggcaaagaggcattgacccaaacacccacaagccactctctgaggttgagaacgaaaaggacatgatgccaccctcaaccgacaaaagcactcagaaagcgtctgtgggatccaatgaagtgagtctggttgatcatcaccagcaacaaccaaaaatcatgcctaattcatcatcagagagataccctcttgaagtttccacaactagttccacccaggaactgttcctagataggtttggtacccccaccacctgccaccaccaccacaacaacaacaacacttctgatgttgtaggatcatacttctccttccagcacttgaactatggaacaacaacaaacatgtccctctctgcaaaccccaacgcctctctttgttttgttccagcctccacttcttcagaccttaataacaattccaccataacctcctccatgctcccttcaattttcccaacacaacacgtgaagctccaatctaataacaacaacccttccatttcatctgatggggttcaaaactgggaaacaagtaacttaaataacagcaacagcacaaacaaaaacaatgggagtatgcagttacaaagctgcacaaacttcattgacaacacgtggggggtgggagagtctatgaaggttgttaacatcaacaaagatgctgatcaaatgcctctacaagcagaacaagaagatctgaaatggtctgagtatcttaataccccgtttattctgggaaacaacacagcgcagaatcatcaaattcatacctctcaatctatctatagtgaggttaaaccagaaacaggtttcataacagacgagtcatgtgctacatggcaccattatcagaatcagacaccagcttttcaactttccgatatatatagcaaggatctgcagagattttcagtgactttcggacaaaccctg

SEQ ID NO: 147 - protein, 428 aa, Glycine max
  Glyma20g22230.1 polypeptide
MGRHSCCYKQKLRKGLWSPEEDEKLLNYITKHGHGCWSSVPKLAGLQRCGKSCRLRWINYLRPDLKRGAFSQQEENMIVELHAVLGNRWSQIAAQLPGRTDNEIKNLWNSCLKKKLRQRGIDPNTHKPLSEVENEKDMMPPSTDKSTQKASVGSNEVSLVDHHQQQPKIMPNSSSERYPLEVSTTSSTQELFLDRFGTPTTCHHHHNNNNTSDVVGSYFSFQHLNYGTTTNMSLSANPNASLCFVPASTSSDLNNNSTITSSMLPSIFPTQHVKLQSNNNNPSISSDGVQNWETSNLNNSNSTNKNNGSMQLQSCTNFIDNTWGVGESMKVVNINKDADQMPLQAEQEDLKWSEYLNTPFILGNNTAQNHQIHTSQSIYSEVKPETGFITDESCATWHHYQNQTPAFQLSDIYSKDLQRFSVTFGQTL

SEQ ID NO: 148 - DNA, 1317 bp, Eucalyptus grandis
  Eucgr.H01337.1
atgggaagacactcttgctgttacaagcagaagcttaggaaaggcctgtggtcacctgaggaagatgagaagctcctcaactacatcaccacgtatggccatggttgttggagcgcagtccccaaactagcaggtttgcaaagatgtgggaagagctgcaggctgagatggatcaattacttaaggcctgacttgaagagaggtgcattttctcaccaagaagagaacctcatcattgagcttcacgctgttcttggtaacagatggtctcagattgcggctcgattaccgggaaggactgacaatgagataaagaatttttggaactcttccctcaagaagaagctgagacaaggagggattgaccccaccactcacaagcccctctccgaggttgctgatgagaacgatcataaagacaaagacaagcccatcattcccagtatcacccaacacaacaacaatgatcatcatcaccagaaatcgtctagcaccgctgcatcatgcaagaaagcaaccctctttgaaccagcattgaacactgataatctcaaagttcatcatcagcagcattcccttgaagttcctgctagctcagagatgaggccttattctgagatgttcatgaaagatttcactttccagcagctgagcatgaactatgggacaagccttgggcttccggctagtctgcatctaagcagcaacactctttgcttcgatccacggtcatcatctgagaatataatgtctcagttcagttcggacatgagcacaccgaacatcatctcacctaccatgtcgagctcaagcaccgctgtcccagtaacttcagctcgtgtaaagccttccattagccttcccgcagaagctgctttcatggtcaacaacggagtcccaagttgggaagcatcacccggtaacaataattgtagcagtggaagtactaatggcaatggattggtaagcaataatagcagcatcaacaacaccgcgttctttgagagcaacaattgtttctcgtgggggcttggtgaaggtactaatgccagcaagtttgaaaagcatgtcccctttcaccaccccataggaagcaatacaacggaagaaaacagcagcaaatggtctgaatatctccagctgccaatcttgttcggaagcttgacacagaataacgatgaagcctctcatcatcatcaaccggtctcacacttccatttgatggatgggctgaacaacattcctagttggcaacagaagcatcaccaacaagccaatccagacacttttgctgctcctgttcttggtcaaactctt

SEQ ID NO: 149 - protein, 439 aa, Eucalyptus grandis
  Eucgr.H01337.1 polypeptide
MGRHSCCYKQKLRKGLWSPEEDEKLLNYITTYGHGCWSAVPKLAGLQRCGKSCRLRWINYLRPDLKRGAFSHQEENLIIELHAVLGNRWSQIAARLPGRTDNEIKNFWNSSLKKKLRQGGIDPTTHKPLSEVADENDHKDKDKPIIPSITQHNNNDHHHQKSSSTAASCKKATLFEPALNTDNLKVHHQQHSLEVPASSEMRPYSEMFMKDFTFQQLSMNYGTSLGLPASLHLSSNTLCFDPRSSSENIMSQFSSDMSTPNIISPTMSSSSTAVPVTSARVKPSISLPAEAAFMVNNGVPSWEASPGNNNCSSGSTNGNGLVSNNSSINNTAFFESNNCFSWGLGEGTNASKFEKHVPFHHPIGSNTTEENSSKWSEYLQLPILFGSLTQNNDEASHHHQPVSHFHLMDGLNNIPSWQQKHHQQANPDTFAAPVLGQTL

SEQ ID NO: 150 - DNA, 1302 bp, Glycine max
  Glyma19g41250.1
atggggagacactcttgctgctacaagcagaagcttcgtaaaggcctctggtctcctgaggaagacgagaagcttttgaattacatcaccaaacatggccatggatgttggagctccgttccaaaactagctggtcttcagaggtgtggcaagagctgcagattaagatggataaattatctcaggcctgatttgaagagaggagcattctcacagcaggaagagaactccatcattgaacttcatgcagtccttggcaacaggtggtcacagattgcagctcagttaccaggaagaactgataatgagataaagaatctatggaactcctgtctgaagaagaagcttaggcaaagaggcattgacccaaacacacaccagcccctctcagaggttgagaatgacaaggacaagcctcttacagctgacaaaagcaaccagaaagcctccaatgaggtgagtcttattgagccaccaaaaccaaagccaatatctactacttctatgcccatggatagatatccccttgaagtttcttcaactttcaagatcagcggtggcaacaacaacaataacaacagcaacagcaccctagacaggtttgacagctccatcactagttctgatatgatgggaatgggatatttcccttttcagcacttgaactatggatcaaacatgggactcactactacacccaacaacactccactttgcttcatgccaagttccacttcttctcaaatgatgtcagagctgaattccaccatgctccattctatgttcccaacacatgtaaaacccactgttagcctccactctaacaacaacaacaacccttcttccatatcctctgatggggttcagaactgggaaacaagtaccttcagtaataacaacaatgcaagcaaaagcaatgggagtagtagctgcagcatccaattacaaagcggcagcactaactttcttgatcatagcagcacaataacatgggggctgcaagcagaatctgccaccaaggcagataaagatgctcatgttgttgtacctttgcaatcatcggaacaagaagacattaaatggtctgaatatctcaacaacacccctttctctctgggaaccatgtcagtgcagcatcaaactacaaactctctctacagtagtgatgaggtgaagccagaaacaacaggcttcatagcagacgaatcaagtaccagttggcaccacagccagcattttcaaccttcggaaatatataccaaagatctgcagagattttcagtggcttttggacaaaccctg

SEQ ID NO: 151 - protein, 434 aa, Glycine max
  Glyma19g41250.1 polypeptide
MGRHSCCYKQKLRKGLWSPEEDEKLLNYITKHGHGCWSSVPKLAGLQRCGKSCRLRWINYLRPDLKRGAFSQQEENSIIELHAVLGNRWSQIAAQLPGRTDNEIKNLWNSCLKKKLRQRGIDPNTHQPLSEVENDKDKPLTADKSNQKASNEVSLIEPPKPKPISTTSMPMDRYPLEVSSTFKISGGNNNNNNSNSTLDRFDSSITSSDMMGMGYFPFQHLNYGSNMGLTTTPNNTPLCFMPSSTSSQMMSELNSTMLHSMFPTHVKPTVSLHSNNNNNPSSISSDGVQNWETSTFSNNNNASKSNGSSSCSIQLQSGSTNFLDHSSTITWGLQAESATKADKDAHVVVPLQSSEQEDIKWSEYLNNTPFSLGTMSVQHQTTNSLYSSDEVKPETTGFIADESSTSWHHSQHFQPSEIYTKDLQRFSVAFGQTL

SEQ ID NO: 152 - DNA, 1338 bp, Populus trichocarpa
  POPTR_0013s00290.1
atggggcggcattcttgctgttacaagcagaagttaagaaaaggcctgtggtctcctgaggaagatgagaaacttcttaattatattactaagcatggacttggttgttggagctctgtccctaaactggcaggtttgcagagatgtggtaagagctgcaggttaaggtggattaactacttgaggcctgatttgaagagaggagcattttctcagcaggaagagaacttgattattgaactccatgcagttcttggcaatagatggtctcagattgcagcacagttacctggaagaactgataatgagataaagaatttatggaattcctgcattaagaagaaactgaggcagagaggcattgaccccaacactcacaaatcactttctgaagctgaggatggtaaagggaagcagcagctcacagctgacaaaagcaatgagaaagtttctattgtatcaaatgaactgaacctcattaagacagctactttaaaaccacctgcagtttcttccagaagctcaaacgtcatcaccaccaacaacaataaggacagaagtggtagtagcaacttgacaaatgttccaccgacacaggaattcttcctcgacaggtttggtacctcccatgaaagctccaccacggccagttgcatgccttctgatttgatggattatttccctttccagaaattggattacaaacctattatagacctctcaatgaatccaaactccactctctgctttaatccaaattcctcctcttctgagatgatttctcatgagttcaattctagtatgacacctccgactattctcccatccgtgtcaacctctatgttccagactccaatatgtgtaaaaccttctgttagtcttccatctgatcataatccttctgtaggctcttgtgatgtcaatggggttcagaactgggaagcaagtagcttcagcaacaacggaagtggaagcaatggaagcagtagcagtattgaattgcaaagcaacaccaatttctttgagagcagcgccttctcgtggggtttagctgattgtgggaaatccagcgacgaagctcaccttcgatctctcgcaaacgagacggttgaagacatcaaatggtctgaataccttagcaccccattctttcttggaagcacaatacaaaaccaaacatctcaacatgtgtacagtgaagtgaaacctgaaacacacttcatagcacaagggtcaagtactagttggctaaagaatcaacatcaacaagcttcacagccagcagacatctataccaaggatctgcaaagacttgctgtggcttttggtcaatccata

SEQ ID NO: 153 - protein, 446 aa, Populus trichocarpa
  POPTR_0013s00290.1 polypeptide
MGRHSCCYKQKLRKGLWSPEEDEKLLNYITKHGLGCWSSVPKLAGLQRCGKSCRLRWINYLRPDLKRGAFSQQEENLIIELHAVLGNRWSQIAAQLPGRTDNEIKNLWNSCIKKKLRQRGIDPNTHKSLSEAEDGKGKQQLTADKSNEKVSIVSNELNLIKTATLKPPAVSSRSSNVITTNNNKDRSGSSNLTNVPPTQEFFLDRFGTSHESSTTASCMPSDLMDYFPFQKLDYKPIIDLSMNPNSTLCFNPNSSSSEMISHEFNSSMTPPTILPSVSTSMFQTPICVKPSVSLPSDHNPSVGSCDVNGVQNWEASSFSNNGSGSNGSSSSIELQSNTNFFESSAFSWGLADCGKSSDEAHLRSLANETVEDIKWSEYLSTPFFLGSTIQNQTSQHVYSEVKPETHFIAQGSSTSWLKNQHQQASQPADIYTKDLQRLAVAFGQSI

SEQ ID NO: 154 - DNA, 936 bp, Vitis vinifera
  GSVIVT01017716001
atggggaagcactcttgctgttacaagcagaagctaaagagaggcctgtggtctccagaagaagatgagaagcttttcaggtatatcacggagcatggacatgggtgctggagctctgtccctaaacaagcaggtttgcaaaggtgtggcaagagttgcaggctaaggtggattaactatttgaggcctgatttgaagaggggcgccttcacaggacaggaagagaagcttatagttgaactgcatgaaattcttggcaacaggtggtctcagattgcttcccacttaccgggaagaacagacaatgaaattaaaaaccagtggaactctagcattaagaagaaactcaggcagaaaggcatcgacccaaacacccacaagccactttctgaaattgacaaccgaccaacggccaataattcctccatggagctggagctagagctagagccactactaaacaatgaggaaagcctcactaccattttttgcaggcctggggaggtgacaggacggttgaattatgagtctaatccccactttccatttgatctgcatcccggatcatggttaagccaaaacagcatctcttcccagctcaactcccaattccattccacctccatttctacttttctccaaactgattttagctcaactgggtcagttctgcctctacaatctcccagaggaatccagtatgcttctgctagctccagcagcagccaattctcttggggactggccgattggggattatcagatcaagaaggcaaattgggagataacaaacagttggagcatctcagcacaccttctttttctaattggaataagaactgcttctcagattacaagtgtttctgcctttacaggtcgcatgcatgtccatcttattgcatagggtatgaccaaatacaaatccaaggtaatggg

SEQ ID NO: 155 - protein, 312 aa, Vitis vinifera
  GSVIVT01017716001 polypeptide
MGKHSCCYKQKLKRGLWSPEEDEKLFRYITEHGHGCWSSVPKQAGLQRCGKSCRLRWINYLRPDLKRGAFTGQEEKLIVELHEILGNRWSQIASHLPGRTDNEIKNQWNSSIKKKLRQKGIDPNTHKPLSEIDNRPTANNSSMELELELEPLLNNEESLTTIFCRPGEVTGRLNYESNPHFPFDLHPGSWLSQNSISSQLNSQFHSTSISTFLQTDFSSTGSVLPLQSPRGIQYASASSSSSQFSWGLADWGLSDQEGKLGDNKQLEHLSTPSFSNWNKNCFSDYKCFCLYRSHACPSYCIGYDQIQIQGNG

SEQ ID NO: 156 - DNA, 1254 bp, Glycine max
  Glyma03g38660.1
atggggagacactcttgctgctacaagcagaagcttcgtaaaggcctctggtctccggaggaagacgagaagcttttgaattacatcaccaaacatggccatggatgttggagctccgttccaaaactagctggtcttcagaggtgtggcaagagctgcagattaaggtggataaattatctcaggcctgatttgaagagaggagcattctcacagcaagaagagaattccattgttgaacttcatgcagtccttggcaacaggtggtcacagattgcagctcagttaccaggaagaactgataatgagataaagaatctatggaattcctgtctgaagaagaagcttaggcaaagaggcattgacccaaacacacaccaacccctctctgagattgagaatgacaaggacaagcctctcacagctgacaaaagcaaccagaaagcctccaatgaggtgatgagtcttgttgagccaccaaaaccaaagccaatagctactactgcaactacttctatgcctatggatagacatccccttgaagtttcttccacctccaagatcagcagtggcaacaacaacagcaccctagacaggtttgacagctccatcactagttctgatatgatgggaatgggatattttcctttccagcacctcaactatggaccaaacatgggactcactactactcccaacaacaccccactttgcttcataccaagttccacttcttctcaaatgatgtcagagctgaattccaccatgttccattctatgtttccaacacatgtaaaacccactgttagtcttcactctaacaacaacaacaacccttcttcaatatcctctgatggtgttcagaactgggaagtaggtaccatcagtaacaacaacaacaacaacaatgcaagcaaaagcaatgggagcagtagctgcagcatccaattacaaagcagcagcacaataacatgggggctgcagcaagcagaatctgccaccaaggcagaacaagaagacattaaatggtctgaatatctcaacaacacccctttctatctgggaaccacgccagtgcagcatcaaaccacaaactctctctacagtagtgatgaggtcaagccagaaacaacaggcttcatagcagacgaatcaagtaccatgagttggcaccacagccagcataattttcaaccttcggagatatataccaaagatctgcagagattttcagtggcttttggacaaaccctg

SEQ ID NO: 157 - protein, 418 aa, Glycine max
  Glyma03g38660.1 polypeptide
MGRHSCCYKQKLRKGLWSPEEDEKLLNYITKHGHGCWSSVPKLAGLQRCGKSCRLRWINYLRPDLKRGAFSQQEENSIVELHAVLGNRWSQIAAQLPGRTDNEIKNLWNSCLKKKLRQRGIDPNTHQPLSEIENDKDKPLTADKSNQKASNEVMSLVEPPKPKPIATTATTSMPMDRHPLEVSSTSKISSGNNNSTLDRFDSSITSSDMMGMGYFPFQHLNYGPNMGLTTTPNNTPLCFIPSSTSSQMMSELNSTMFHSMFPTHVKPTVSLHSNNNNNPSSISSDGVQNWEVGTISNNNNNNNASKSNGSSSCSIQLQSSSTITWGLQQAESATKAEQEDIKWSEYLNNTPFYLGTTPVQHQTTNSLYSSDEVKPETTGFIADESSTMSWHHSQHNFQPSEIYTKDLQRFSVAFGQTL

SEQ ID NO: 158 - DNA, 1353 bp, Eucalyptus grandis
  Eucgr.B01827.1
atgcttcaagcatctgctgatataattagtttacgacactcacaattcatttctgcgacatctatcactgtctctacctacaatattcctttcacacattctccatttcatttgcctcacagattagagcgattcttccggaaatctaggcacttttgcatgggaagacactcttgctgtcacaaacagaagctgaggaaaggtctgtggtctcccgaggaagatgagaaacttttgaactacatcgccaaatttggactcgggtgttggagctcagtcccaaagcttgcaggcttgcaaagatgtgggaagagttgccggttaaggtggataaactatctaaggcccgacttgaagagaggtgcattctcccagcaggaagagagtttgataattgaactccatgcagttctaggcaacagatggtcacagattgcagcgcatttgcctggaaggaccgacaacgagataaagaacttgtggaactccggattaaagaagaagctcaggaaaaatgggattgaccccaatacccacaagcccctttccttgtttgaaaacagtgaccaacaaaagtttcatgcaatatatgaagcctctgttgcatccactaaaccgaacctttcccaggccagttccacaagtagcagccagaatctgagagtgactccatctcctgagctctcatttaagaggcccggtatagtcgatgatggaagcttcatcacctgttttccacctgctggtatggtgggcgagctatgctttcagcacttaaaatgttcaggtaccatgggtctattggcaagttcagatactgctctacatcacgattggaattggagctcctcagatatcagtccaacacaggtccattcagctccaaagccaaatagaccctctgacagctattattgcaatattgatggcggtaatagtagccactggagcggcattgctccattgcagaatgttcatacctttgaaaactccccaaattcatatatatcggctgactgcgggagagtcgacaaagaaactgagactcacccatcggtgtttgatgcagaagttgcgaaatggttcgaatatctccaccacactccatttgtgtttaacctctcaccaagtggagcttctcaactggagcacagtgacgtgacgccatcagcaggcacatgctcagtgactggtggtggcttggtcagcaattgcccacatgatcagattctgcaagcttcaccaggctctgacatgtatggcaagactcttcaagttattgccgtttcttcagggcaaaattctccgtcttctttggagcctgtgaagaacaagtttcaagacaagaaagta

SEQ ID NO: 159 - protein, 451 aa, Eucalyptus grandis
  Eucgr.B01827.1 polypeptide
MLQASADIISLRHSQFISATSITVSTYNIPFTHSPFHLPHRLERFFRKSRHFCMGRHSCCHKQKLRKGLWSPEEDEKLLNYIAKFGLGCWSSVPKLAGLQRCGKSCRLRWINYLRPDLKRGAFSQQEESLIIELHAVLGNRWSQIAAHLPGRTDNEIKNLWNSGLKKKLRKNGIDPNTHKPLSLFENSDQQKFHAIYEASVASTKPNLSQASSTSSSQNLRVTPSPELSFKRPGIVDDGSFITCFPPAGMVGELCFQHLKCSGTMGLLASSDTALHHDWNWSSSDISPTQVHSAPKPNRPSDSYYCNIDGGNSSHWSGIAPLQNVHTFENSPNSYISADCGRVDKETETHPSVFDAEVAKWFEYLHHTPFVFNLSPSGASQLEHSDVTPSAGTCSVTGGGLVSNCPHDQILQASPGSDMYGKTLQVIAVSSGQNSPSSLEPVKNKFQDKKV

SEQ ID NO: 160 - DNA, 1278 bp, Solanum lycopersicum
  Solyc01g102340.2.1
atggggaggcattcttgttgctacaaacagaagttaaggaaaggcctttggtctcctgaagaagatgagaaacttataaagcatattactaaatttggtcatggctgttggagctctgtccctaaactagcaggtctccagaggtgtggaaaaagttgtagactgaggtggattaactacttgaggcctgatttgaaaagaggaacattctcacaggatgaagaaaatttgatcattgaacttcatgcagttcttgggaacaagtggtcgcaaattgcagctagattacctggaagaacagataacgagataaagaatctgtggaactcttcaattaagaaaaagcttaggcaaagaggaattgatcctaatacacacaagccactttccgaactagagaacgaagagaaagcgtcggcaaacagtaacactaagaacaatgacaaagtttcagaaagttcaaataatgaattcaattttgttgagaatggattttcaacagaaaaaccaattaagccggccgtatcttcaatgataaatactttggagcgttatccacttattcatgagccaaataatattgccccaccaactcatgaatttttcaccaccaattgcaagtctcctgatttgtctaattatctctcttttcacaattattctcccaacacgaatattctcttcaataccaaaacctcttcttcatctgctgctgacaatattatatctgatcatcagttcaattgtagcactttgacaaatgctactttttctactatgtcgaattcgattctcagtactaccatatcgccgttggcgcgtaattttaatatcaacaagtttcagaattgggaagcgtgtacgatcagcagcaatggcagcaacaatagtaatggtactagtaacagtatcgaattacaaagtaactgttcattcttcgataacaatgctgcagccgctttcgcttggggatcagcgggcgcaactgcagcagcagactgtacgggaaaatcggagagggaagaaatcaaatggtctgaatatttacaaacaccgttttcactaggtgttaacaataacacaatcgacactcatcatcaacatcaaattccttcgcatcatgaattgtacgacggggaaacaaaatcaaagacacaatttatgacccaaggttcatggcttcagaatcaaacgccgcagacttcttctctacagactgcagaattatacagtaacaacaatttccaaaggcttccagccgtttacggacaattttct

SEQ ID NO: 161 - protein, 426 aa, Solanum lycopersicum
  Solyc01g102340.2.1 polypeptide
MGRHSCCYKQKLRKGLWSPEEDEKLIKHITKFGHGCWSSVPKLAGLQRCGKSCRLRWINYLRPDLKRGTFSQDEENLIIELHAVLGNKWSQIAARLPGRTDNEIKNLWNSSIKKKLRQRGIDPNTHKPLSELENEEKASANSNTKNNDKVSESSNNEFNFVENGFSTEKPIKPAVSSMINTLERYPLIHEPNNIAPPTHEFFTTNCKSPDLSNYLSFHNYSPNTNILFNTKTSSSSAADNIISDHQFNCSTLTNATFSTMSNSILSTTISPLARNFNINKFQNWEACTISSNGSNNSNGTSNSIELQSNCSFFDNNAAAAFAWGSAGATAAADCTGKSEREEIKWSEYLQTPFSLGVNNNTIDTHHQHQIPSHHELYDGETKSKTQFMTQGSWLQNQTPQTSSLQTAELYSNNNFQRLPAVYGQFS

SEQ ID NO: 162 - DNA, 1245 bp, Glycine max
  Glyma19g41010.1
atgggaaggcactcttgctgttacaaacagaaacttaggaagggtctttggtcaccagaagaagatgaaaaacttctgaggcatattacgaagtacggtcatggatgttggagctcagttcctaagcaagcaggtttgcagaggtgcggcaagagctgcaggcttaggtggatcaattacttaaggcctgatttgaagagaggtacattctcacaagaggaggaaactctcatcattgaacttcatgcagtgctagggaacagatggtctcaaattgcagctcaattgccagggaggaccgacaatgaaataaagaatctgtggaattcttgcctaaagaagaaactgaggcaaagaggaatagaccctgtgacacataagccactgtcagaggttgagaatggggaagaggacaaaacaagaagccaagagttatccaatgaattgaacctcctgaattcagagagcttcaagtcagatgaagggtcctatgagcagagagcatcatcatcaattgcccccaaagcctatgagatggaaggctcttgcagctccaagattaacaccaccaaaaatgacaccaacttgatgtccaattgttccaacaaagacatgttcttagacagctacaccactagttgccaaccctcagatttgatgggaaattaccctcttcaaatcactgacactctcccaaccaattcaaactcttgccattggttcagccaaactgcaagaccctttgatatgaactctgagtttacaatcacttccaatgttatgtccattcttccacctacaacaacctcatttctcccaagcacttctttttgctacaagccatcacttggtgtcccttcagaagatatttcaacagcatcttttgctttgaatggtcccaattactgggaagccagtgcctccaacaacagcaatggaagcaacaacacaagtgatggcagcagagagttgacaactacaagtagcaagaacagtgtactctcttcttggggattgacagaagaaacaaagtggtctgagtacctccaaaacccaatgctaatgctggcagctcctgaatcattgtgcaaccaaattaggccagccacacatttggtacctgataacactttagggtcaataatagtgcctgattccaaggaccaacaacaacaacaacaatctcaaaattctagcatcttctccaaggacacgcagaagctaacagcagcctttggacatata

SEQ ID NO: 163 - protein, 415 aa, Glycine max
  Glyma19g41010.1 polypeptide
MGRHSCCYKQKLRKGLWSPEEDEKLLRHITKYGHGCWSSVPKQAGLQRCGKSCRLRWINYLRPDLKRGTFSQEEETLIIELHAVLGNRWSQIAAQLPGRTDNEIKNLWNSCLKKKLRQRGIDPVTHKPLSEVENGEEDKTRSQELSNELNLLNSESFKSDEGSYEQRASSSIAPKAYEMEGSCSSKINTTKNDTNLMSNCSNKDMFLDSYTTSCQPSDLMGNYPLQITDTLPTNSNSCHWFSQTARPFDMNSEFTITSNVMSILPPTTTSFLPSTSFCYKPSLGVPSEDISTASFALNGPNYWEASASNNSNGSNNTSDGSRELTTTSSKNSVLSSWGLTEETKWSEYLQNPMLMLAAPESLCNQIRPATHLVPDNTLGSIIVPDSKDQQQQQQSQNSSIFSKDTQKLTAAFGHI

SEQ ID NO: 164 - DNA, 1284 bp, Oryza sativa
  LOC_Os01g18240.1
atggggagacattcctgctgctacaagcagaagctgaggaaggggctctggtcacctgaggaggatgagaagctcatgaaccacataaccaagcatggccatggctgctggagcaccgttccaaaacttgcagggcttcagagatgtggcaaaagctgcaggctgagatggataaactacttgaggcctgacctaaagagaggtgcattctctcaggaggaagaggacctcatcgttgagctccatgctgttctgggaaacaggtggtctcaaattgcaacacggctgcctggaagaactgacaatgagatcaagaatctctggaattcatgcatcaagaagaagctgcggcagaaaggcattgacccaaacacccacaagccccttgccgaggttgatcgaagcaaagcaactcccaccatcagcaatgacaggacctctgaatccagcgatgttgacccatctagtggcgttgctcttcacaacttgagccatcttctgagcgagacggcgcaatcatcagagctgctgccagtgaaggtaactaaacctcgcacacaagctccgggcttggcacgtctgaaggtgccaccgaaggaactatttctagaccagcttacttctggccatgagaacctccctagctgccgttcatctggcccaattcccaatttcccgttccagcagctgttgtgctacaataatgattttaacagcatggacgttggaaacaggaattcactctggtataaccagaatgagtccagtagcagcacaatttccactgtgatgcccccagtttcaccatcaactctctcgacatcaacaggccttaatccatcaccagacaatgcaaactctcgaggcactggcatccacaattcccaattctattgggacaccaacaatcctagcagcagtagcagtacagggagtagtggtaacaacgggttgggattcgagctgcaaagcacaagctcccttttggagaccaacatattcccatggtcagatttagcaccagaaaaggatagccaagcacaactagaggaagaactcaagtggcctgacttgctccatggaacgttctcagagatgccagcgcccatgcagaaccttagccagtcactgtatgaagacgttgtcaaagcagagagccaattcaacatggaggggctctgtgcagcttggtctcaaaacctgctgccacagcaacatcttccagtagtatcagatatgtatgacaaggatttgcaaaggatgtccttgtcttttgagaatatc

SEQ ID NO: 165 - protein, 428 aa, Oryza sativa
  LOC_Os01g18240.1 polypeptide
MGRHSCCYKQKLRKGLWSPEEDEKLMNHITKHGHGCWSTVPKLAGLQRCGKSCRLRWINYLRPDLKRGAFSQEEEDLIVELHAVLGNRWSQIATRLPGRTDNEIKNLWNSCIKKKLRQKGIDPNTHKPLAEVDRSKATPTISNDRTSESSDVDPSSGVALHNLSHLLSETAQSSELLPVKVTKPRTQAPGLARLKVPPKELFLDQLTSGHENLPSCRSSGPIPNFPFQQLLCYNNDFNSMDVGNRNSLWYNQNESSSSTISTVMPPVSPSTLSTSTGLNPSPDNANSRGTGIHNSQFYWDTNNPSSSSSTGSSGNNGLGFELQSTSSLLETNIFPWSDLAPEKDSQAQLEEELKWPDLLHGTFSEMPAPMQNLSQSLYEDVVKAESQFNMEGLCAAWSQNLLPQQHLPVVSDMYDKDLQRMSLSFENI

SEQ ID NO: 166 - DNA, 1272 bp, Setaria italica
  Si001565m
atggggaagcactcctgctgttacaagcagaagctgaggaaggggctctggtctcctgaggaagacgagaagctcatgaaccacataaccaagcatgggcatggctgctggagcactgttccaaagcttgcagggcttcaaaggtgtggcaagagctgcaggctgaggtggataaattacctgaggcctgaccttaaaagaggtgcattctctcaggaggaggaagaccttatcattgaacttcatgctgtcttgggcaacaggtggtctcagattgcaacacggttgcctggaagaactgataacgagatcaagaatctctggaattcaagcatcaagaagaagctccggcagaaaggcatcgaccccaacacccacaagccccttgctgaggttgatcgcaaaatagctccaacaatcagtactgagagaacctccgagtccagcgatattgacccttcaagtggtggtgcacttggcaacttgagccatctcctcagtgagacagcacaatcaccagagctgctgccagtgctcggtaagcatcgcaaagaaactactagtttggcacatctaagggtgccatcgaaggagctattccttgaccagcttgtttctggtaatgataacctccccagctgccgctcaacaggcccaattccaaatttccctttccagcagttgatgtgttacagcaatgaatttggcggcaagcatggaggcagcacgaatccactctggtttaaccagaatgagtcaagctgcagcaccatttccactgtgatgccaccagtttcgccatcaactctctcaacatcaacaggactcaataggtcaccggacaatccacactctggaggtactggcattcagagtaaccaattctactgggacaccactaatcctagcagcagtagcagtaaaggaagcagtggaagcaatagcttgggatttgagctgcaaagcacaagctcaattctggagaatagtatcttcccatggacagatttatcgccagataaaaatagccacctagaggaagaactcaagtggcctgacctgctccatggaaccttcacagatacaccagcaaccatgcagaatcttagccaatcactgtatgaagatgtggtcaaagccgagaaccaattcaacatggagggcctctgtgcagcttggtctcaaaatttgcagccacagcaacatctgcaggtagcatcagatttgtatgacaaggatttgcagagaatgtccttgtctttcgagaatatc

SEQ ID NO: 167 - protein, 424 aa, Setaria italica
  Si001565m polypeptide
MGKHSCCYKQKLRKGLWSPEEDEKLMNHITKHGHGCWSTVPKLAGLQRCGKSCRLRWINYLRPDLKRGAFSQEEEDLIIELHAVLGNRWSQIATRLPGRTDNEIKNLWNSSIKKKLRQKGIDPNTHKPLAEVDRKIAPTISTERTSESSDIDPSSGGALGNLSHLLSETAQSPELLPVLGKHRKETTSLAHLRVPSKELFLDQLVSGNDNLPSCRSTGPIPNFPFQQLMCYSNEFGGKHGGSTNPLWFNQNESSCSTISTVMPPVSPSTLSTSTGLNRSPDNPHSGGTGIQSNQFYWDTTNPSSSSSKGSSGSNSLGFELQSTSSILENSIFPWTDLSPDKNSHLEEELKWPDLLHGTFTDTPATMQNLSQSLYEDVVKAENQFNMEGLCAAWSQNLQPQQHLQVASDLYDKDLQRMSLSFENI

SEQ ID NO: 168 - DNA, 1281 bp, Brachypodium distachyon
  Bradi2g36730.1
atggggaggcattcttgttgctacaagcaaaaattgagaaaggggctatggtcccctgaggaggatgagaagctcatgaatcacataaccaagcatggccatggctgctggagctcagtccctaaactcgcagggctccaaaggtgtggcaagagctgcaggctgagatggataaactacctgaggccagacctcaagagaggtgcgttcgctcaggacgaggaagacctcatcattgagctccacgctgtacttgggaacagatggtcacaaattgcagcacagatgcctggaaggactgacaatgagatcaagaacctctggaactcgtccctcaagaagaagctgcgacaaaaaggcattgatcccaacacccacaaacccctcactgaggttgatcgcagtggagcagctcccaccatcagtaccgagaggacctctggttccagtgacgtcaacccgtcaagtgctggtgctctagggaacttcagccacctcctcagcgagacagcccaatcatcaatgctgctgccagtgtatgataagaaacgccctgaaactgcaagcttggcacgccctaaggtgccagcaaaggaattgtttctggaccagcttactgctggtcatgagagcccatcaagctgccgttcatcaggtccaacgctgtatttccctttccagcagccattaggctacagcaatgagtgtggcaatggtgacggtgcaaatatgaattcactctggttcaaccagaatgatttcaactgcagcacaatttccaccatgatgccaacagtttcaccatcagccctctcaacatcaatgggcctgaatctcccaccagacaatcaccgccacgggggcactggcatcagcagcgcccctttctactgggatggtgttaatcctagcagcagcggcagtactgggagcagtggaagcaacagtatgggattcgagccgcagagcacaaactcaattctggagaacagtgtattcccatggactgatatcggacaagaaaaagataccagagttcaattagtggaggaactcaagtggcctgacttgctccatggaacctttgcagaggcaaccacagcattgcagaaccaaagccaatcattatatgatgatgtgatcaaggcagagagccaattcaacatggaagggatatgtgcttcttggttccagaatcagccgccacagcaacagctgcaagcgccatcagacatgtatgacaaagacttgcaaagaatgcccttgtcttttgagcatatg

SEQ ID NO: 169 - protein, 427 aa, Brachypodium distachyon
  Bradi2g36730.1 polypeptide
MGRHSCCYKQKLRKGLWSPEEDEKLMNHITKHGHGCWSSVPKLAGLQRCGKSCRLRWINYLRPDLKRGAFAQDEEDLIIELHAVLGNRWSQIAAQMPGRTDNEIKNLWNSSLKKKLRQKGIDPNTHKPLTEVDRSGAAPTISTERTSGSSDVNPSSAGALGNFSHLLSETAQSSMLLPVYDKKRPETASLARPKVPAKELFLDQLTAGHESPSSCRSSGPTLYFPFQQPLGYSNECGNGDGANMNSLWFNQNDFNCSTISTMMPTVSPSALSTSMGLNLPPDNHRHGGTGISSAPFYWDGVNPSSSGSTGSSGSNSMGFEPQSTNSILENSVFPWTDIGQEKDTRVQLVEELKWPDLLHGTFAEATTALQNQSQSLYDDVIKAESQFNMEGICASWFQNQPPQQQLQAPSDMYDKDLQRMPLSFEHM

SEQ ID NO: 170 - DNA, 1311 bp, Setaria italica
  Si029872m
atgttaacgcaaagcggatggatcagtcgagctgtgtgtgcgcaaagcccaacagggccatgcatgcactcgcaccccagtgtcaaaggtgaaaataattcggctggagaaagtgcaggcggagtagtggctagtgggaggcagccttgccctaccaataacaaggacacagttcggtggacagtgttacgttggcagcaactgccgcaacggccgccgcagctctcctttgcgtgcggtagctcatcggttgggggtggcatcatggcgaggaggacgagcggtcccaagaagaagctgaggagaggactctggtcgccggaggaggatgagaagctgatgaaccacattgccaagtatggccatggctgctggagttccgtccccaagcttgcaggccttgagaggtgtggaaagagctgcaggctgaggtggatcaactacctgaggccggacctcaagaggggcgcgttctcgcaggaggaggaggacctcatcatccatctccactccatgctgggcaacaagtggtctcagattgcagcgcagctgccggggcggacggacaacgaggtcaagaacttctggaactcgtacatcaagaagaagctccggcagcgcggcatcgacccggacacgcacaagccgctggccgaggccagcagcagccgcgggggcggcgccgccgcagccagccgcacggcggtgttcagcgacgccgagctcatcctgtcgtcggcggcgggcaagcacatgccgccgccgccggtgacggcggagagctacgtgtacagccgcagcatcagcgccgacggcggcgtgagcgacggctccctgcagtcgctgtccgggtacaacggggacttcgccgcgggctacctgcaggaaccggacgcgctgcagcagggcggcccctccgatggcccgccggcggtagttctcccgtcggtgtcgagctccagcacgctgaactcgatggctggcctaagccccccggccaccacggccaccgacgaacagtgcaacaacaacagtagcagcggcggcggcaacgggtcgttcgagctgtcgacgcagcagagctgcagcgctagccagctgccatggctggagctgggcacgagcagcggcgccgccgccgtcttggaccagtacggcgcggcgctggacgagctcaagtggtccgactacgtgttcgacggctacggcggcggcgggcagtaccagcagggacagtgcatctacggcgacagcaaggacgccgtgcagttcgtcgacgccagcggactcagcagcagttggtgcttgaat

SEQ ID NO: 171 - protein, 437 aa, Setaria italica
  Si029872m polypeptide
MLTQSGWISRAVCAQSPTGPCMHSHPSVKGENNSAGESAGGVVASGRQPCPTNNKDTVRWTVLRWQQLPQRPPQLSFACGSSSVGGGIMARRTSGPKKKLRRGLWSPEEDEKLMNHIAKYGHGCWSSVPKLAGLERCGKSCRLRWINYLRPDLKRGAFSQEEEDLIIHLHSMLGNKWSQIAAQLPGRTDNEVKNFWNSYIKKKLRQRGIDPDTHKPLAEASSSRGGGAAAASRTAVFSDAELILSSAAGKHMPPPPVTAESYVYSRSISADGGVSDGSLQSLSGYNGDFAAGYLQEPDALQQGGPSDGPPAVVLPSVSSSSTLNSMAGLSPPATTATDEQCNNNSSSGGGNGSFELSTQQSCSASQLPWLELGTSSGAAAVLDQYGAALDELKWSDYVFDGYGGGGQYQQGQCIYGDSKDAVQFVDASGLSSSWCLN

SEQ ID NO: 172 - DNA, 1392 bp, Populus trichocarpa
  POPTR_0014s10680.1
atggggaggcactcttgttgctacaagcagaagctaaggaaaggcctgtggtcgcctgaggaagatgagaaactcttaaggcatatcaccaagtatggccatggttgttggagctctgtcccaaagcaagctggtttgcaaaggtgtggcaagagctgcagactaaggtggattaattacttgaggcctgatttgaagagaggcacattctcacagcaggaagagaacctcataattgagcttcatgcagttctaggaaataggtggtctcagattgcggcacaattgcctggaaggacagacaatgaaataaagaatctatggaactcctgcttaaagaaaaaacttcggcagagaggcattgaccctgttacccacaaaccactttctgaggttgaaaatggagaagacaagaatccacctgctagtggcacccaagataaagcctctgcagtctccaatactgaactcaacctcctcaaagctgataattctaagtcatcaggagcaaatttacaagaaaaaagatcatctccaatttctccaaatggctaccaattggagagggaaagtacttccggctccaaggtcatgaatggcaacggcaataacaccaatgaccatgttaacaacaatttgatgacaccaacaagcaacaaagactttttcttggataggtttacagcctcccaccatcaaggttccacaagtaactgccagccttcggatttcgtggggcatttccctcttcagcaattgaattatgcatccaatgccaggctcgcaacgaactcgattccctccctctggttgagccaaaccagcaaagcctttgacatgaactctgaattctcttcgactgcgataccctccattcttccaccagcagtaacaagctcatttcattctacttctatgagctacaagccttccattactgtttcacctgacaatccttcattgccctcttttactaccaacagctgtcggctgtgggaaaccggtacccccagaagcaacagtaacagcaatactgtaagcaatggcagtaccgagctgcaaagcaacagctccttctttgagaacgccatcttttcttggggactaggagagtgtggctcagcagaaaaagaggcacagaaccacttgatgggaagccagcacgaggacatcaagtggcctgaatatcttcaaaatccattgctcatggctgctgctttacaaaatcaaaatcagcaatcattgtacaatgagataaaatcagaaacgcaagtcgtaactgaaaattcaagtggtatgtggcctcataaccaccagcagcagcaacctttacaaaatcctgatatatgtcccagggatattcagagaattacagcatcatatggatatatt

SEQ ID NO: 173 - protein, 464 aa, Populus trichocarpa
  POPTR_0014s10680.1 polypeptide
MGRHSCCYKQKLRKGLWSPEEDEKLLRHITKYGHGCWSSVPKQAGLQRCGKSCRLRWINYLRPDLKRGTFSQQEENLIIELHAVLGNRWSQIAAQLPGRTDNEIKNLWNSCLKKKLRQRGIDPVTHKPLSEVENGEDKNPPASGTQDKASAVSNTELNLLKADNSKSSGANLQEKRSSPISPNGYQLERESTSGSKVMNGNGNNTNDHVNNNLMTPTSNKDFFLDRFTASHHQGSTSNCQPSDFVGHFPLQQLNYASNARLATNSIPSLWLSQTSKAFDMNSEFSSTAIPSILPPAVTSSFHSTSMSYKPSITVSPDNPSLPSFTTNSCRLWETGTPRSNSNSNTVSNGSTELQSNSSFFENAIFSWGLGECGSAEKEAQNHLMGSQHEDIKWPEYLQNPLLMAAALQNQNQQSLYNEIKSETQVVTENSSGMWPHNHQQQQPLQNPDICPRDIQRITASYGYI

SEQ ID NO: 174 - DNA, 1392 bp, Populus trichocarpa
  POPTR_0002s18700.1
atggggaggcactcttgttgctacaagcagaagctacggaaaggcctgtggtcacctgaggaagatgagaaacttttaagtcatattactaagtatggtcatggttgttggagttctgtcccaaagcaagctggtttgcaaaggtgtggcaagagctgcagactaagatggattaattacttaaggcctgatttgaagagaggcacattctcacatctggaagagaacctcataattgaacttcatgcggttctaggaaacaggtggtctcagattgcggcgcagttgcctggaaggactgacaatgaaataaagaatctgtggaactcttgcttaaagaaaaaacttaagcagagaggcattgaccctgtcacccataaaccactttctgaggttgaagatggagaagacaagaatccagctgccagtagaaaccaagataaagcctctgcagtatccaatactgaactcaacctcctcaaagctgatcattctaagccattaggagcaaatttacaagaaaaaagatcatcttcaatttctcctcatggcaatcaattggagagggaaagtacttccagcttcaaggccatgaatgaaaacaacaacaataccaatgaccatggtaacaataatttgatgacaccaacaagcaacaaggactttttcttcgataggtttacagctttcctccatgaaggctccacgagtaattgcccgccctcgggttttgtgggacatttccctcttcagcaattgaattatgcatccaatgccaggctcgcgacgaactcaattccttctctttggttgagccaaaccagtaaagcttttggcatgaattgtgaattctcttcgactatgataccctccattcctccaccagctgtaacaagctcatttctttcttcttctatgggctacaagccttccattactgttccaccagacaatccttcattgccctcttttacaaccaacagttatcggccgtgggaaaccggtgctcccagcaacaatagtaacagcagtactggaagcaatggcagtactgagctgcaaagcaacagctccttctttgagaacaccatcttttcttggggattaggagactgtagctcaacagaaaaggaggcacagaaccacttgattggaagccaacaggaggacatcaggtggcctgaatatcttcaaaatccattgctcatggctgcttctttgcaaaatcaaaatcagcaatccttgtacaatgagataaaaacagaaacacatctcctaacagaaaatccaagtggtatgtggcctgataaccagcaggaacaggaacctttacagaatcctgatatatgtccgaaagatatgcagagaatcacagcatcttatggatatgtt

SEQ ID NO: 175 - protein, 464 aa, Populus trichocarpa
  POPTR_0002s18700.1 polypeptide
MGRHSCCYKQKLRKGLWSPEEDEKLLSHITKYGHGCWSSVPKQAGLQRCGKSCRLRWINYLRPDLKRGTFSHLEENLIIELHAVLGNRWSQIAAQLPGRTDNEIKNLWNSCLKKKLKQRGIDPVTHKPLSEVEDGEDKNPAASRNQDKASAVSNTELNLLKADHSKPLGANLQEKRSSSISPHGNQLERESTSSFKAMNENNNNTNDHGNNNLMTPTSNKDFFFDRFTAFLHEGSTSNCPPSGFVGHFPLQQLNYASNARLATNSIPSLWLSQTSKAFGMNCEFSSTMIPSIPPPAVTSSFLSSSMGYKPSITVPPDNPSLPSFTTNSYRPWETGAPSNNSNSSTGSNGSTELQSNSSFFENTIFSWGLGDCSSTEKEAQNHLIGSQQEDIRWPEYLQNPLLMAASLQNQNQQSLYNEIKTETHLLTENPSGMWPDNQQEQEPLQNPDICPKDMQRITASYGYV

SEQ ID NO: 176 - DNA, 1218 bp, Eucalyptus grandis
  Eucgr.B02197.1
atggggaggcactcctgctgttacaagcagaagctaaggaaaggcttgtggtctccagaagaagatgagaagcttgttaggcatatcgttaagtatggacatggttgctggagctctgtgcctaaactagctggattgcagaggtgtgggaagagttgtagattgaggtggatcaattacttgaggcctgatttgaagagaggcacattctcacaacaagaggaggacttgataattgagcttcatgctgttcttggaaacaggtggtctcaaattgcgtcacagttgccaggaagaacagacaatgagatcaagaacctgtggaactccagcatcaagaagaagctcattcaaaaaggcattgaccccaacactcacaagccgctttctgaggtcaagaacggaagagaaggggagaaaacgccgaaatccggcaattttggcaacagaacctcaggagggtttagttctatgtacaatcttgaattcgacgctcccaagtcagaggaaagaaagccaatttcacaagatgcagagccatattcactcactggttctttaagcttgaaaattcaccacccggacaccagtaagtctatcaatcccgcacctgccagaaaattgttctcagaaaagtccgcagaccttagcgagaagatccctttcgagccgacccgtattttccctttccagcaactaagctacggttcaagtgctgattattcatttgatccatatctgaaccacaacttcatgctttctgattcgaagtccgccctccactccacttcagcacctgccattttgccacaatctcacagttttagctcattgactgcacaaccccacgagagcttgaagccccatttcggtctcttctccaacgggaagatcaggagcagtgaatcgcagagcagccttttcccctgggacctgcatgctgagaaagaagaagacgaaacccaccagccgaacttcagtggcaacgagtcagaggatctgaaatggtcagactatctgaacatgccattcctgatagctaacccagggcaaggtcaagaaaagcaggctccaccaaatggggttgtgtcagacgcaagattcatctcagaattgtcctgtgttgaagggaataaccagcagcaagaactgccctcacagggttcagacatttactgcaagggtatcaggagattagctgcaacttttgggaattac

SEQ ID NO: 177 - protein, 406 aa, Eucalyptus grandis
  Eucgr.B02197.1 polypeptide
MGRHSCCYKQKLRKGLWSPEEDEKLVRHIVKYGHGCWSSVPKLAGLQRCGKSCRLRWINYLRPDLKRGTFSQQEEDLIIELHAVLGNRWSQIASQLPGRTDNEIKNLWNSSIKKKLIQKGIDPNTHKPLSEVKNGREGEKTPKSGNFGNRTSGGFSSMYNLEFDAPKSEERKPISQDAEPYSLTGSLSLKIHHPDTSKSINPAPARKLFSEKSADLSEKIPFEPTRIFPFQQLSYGSSADYSFDPYLNHNFMLSDSKSALHSTSAPAILPQSHSFSSLTAQPHESLKPHFGLFSNGKIRSSESQSSLFPWDLHAEKEEDETHQPNFSGNESEDLKWSDYLNMPFLIANPGQGQEKQAPPNGVVSDARFISELSCVEGNNQQQELPSQGSDIYCKGIRRLAATFGNY

SEQ ID NO: 178 - DNA, 993 bp, Zea mays
  GRMZM2G147698_T01
atggcgaagcagtcgtgctgccacaagaagaagcttaggagagggctctggtcccccgaggaggacgagaagctcatgaaccacattgccaagtacggccacggctgctggagctccgtacccaagcttgcaggcctcgacaggtgtggcaagagctgcaggctgaggtggataaactacctgaggccagacctcaagaggggcacattctcgcaagaggaggaggacctcatcatacacctccactccttgctgggaaacaagtggtctcagattgcggcccagctgcctggccggacggacaacgaggtcaagaacttctggaactcgtacatcaagaagaggctcagggagcgcggcatcgaccccgccacccaccagccgctcgccgagcctgccgccgcagccactgccaccaccaccaccacggtctcccgccgcgcggtgtttggggacgtcgacctcatcccgactactactactactacaatccaggtgccgccgccgtcgttcgagggcggcccaatgctggagagcgtgaagctagcggtggagctggactggcccgtcgctggcgacggggtaacgtcaaggccatgctacctgcaggggggctgcttcgacatggacgcgctgcagcagcactgcggctccatcccgccggtgccggtcgtcccgtcggcctccgccagctccagcacgctgacctcgatggcggaagcggaacactgcagcaccaacaacgtcgccgccggcggcaacctcccatggctggagctcggggcaaacgcggtggctgacgccggcggccacgtcgtcggcagctgctacgccggcgcgctggacgagctcaggtggtcggagtacttcgacagtgccttccaggccgccgagagccagcaaggcgccctgcagccggggcagtgtgtctacggcggcaaggatgacgtcccggtgcacttcgacgtccatggcgggctaagcaactggtgc

SEQ ID NO: 179 - protein, 331 aa, Zea mays
  GRMZM2G147698_T01 polypeptide
MAKQSCCHKKKLRRGLWSPEEDEKLMNHIAKYGHGCWSSVPKLAGLDRCGKSCRLRWINYLRPDLKRGTFSQEEEDLIIHLHSLLGNKWSQIAAQLPGRTDNEVKNFWNSYIKKRLRERGIDPATHQPLAEPAAAATATTTTTVSRRAVFGDVDLIPTTTTTTIQVPPPSFEGGPMLESVKLAVELDWPVAGDGVTSRPCYLQGGCFDMDALQQHCGSIPPVPVVPSASASSSTLTSMAEAEHCSTNNVAAGGNLPWLELGANAVADAGGHVVGSCYAGALDELRWSEYFDSAFQAAESQQGALQPGQCVYGGKDDVPVHFDVHGGLSNWC

SEQ ID NO: 180 - DNA, 1137 bp, Glycine max
  Glyma02g00960.1
atgggaaggcactcttgttgttacaagcagaagcttaggaagggtctttggtctcctgaggaggatgaaaaacttctgaggcatattactaagtatggtcatggatgttggagttctgtgcctaagcaagcaggtctgcaaaggtgtggtaagagctgcaggcttaggtggatcaattatttaaggcctgatttaaaaagaggaacattctcacaagaagaagaaaaccttatcattgaacttcatgcagtattagggaacaggtggtctcaaattgcggcacagttgccggggagaacagacaatgaaataaagaatctgtggaactcttgcttgaagaagaaactgaggcaaaagggaatagaccctgtcacacataaaccactgtctgaggttgagaatggagagaaagcagcagaagtgtctaatgaactgaacctcctgaaatcagagagctccaaccgccaagagagttacaccactagttgccagccctcagatttgatggggaattttccaattcagatgagttatgcaaccaatgatcagtgtctccctaatgattcaaactctagtcattggttcagccaaactggaaggtcttttgatatgaacactgagtttcctttcaatgccgctgtcacttctatcaatcctacacctacaaccaacttgtttcttcctaataattctttttgctacaagccttcacttgctgttccctctgacaatgtttccataccctatggatcccattactgggaagccagtgcctccaacaacagcaatagtagcacagaattgagaagtagcagccccttgaacatcttttcttcttggggattggcagattgtggcacctctactactaaagaggcacaaattcatatgatggagaatcataatacagaagaagctaagtgggatgagtaccttcataaccctatctcaatgctggcttcttctgtacaaaaccaagctcctgagtctctatgcaatgatataaaaacatccatgcatttggtacctgatactttaggggctatgctacctcataaccataccaagcagcaagaacagtctcaaacttctagtttcttttccaaggacatccagaagctcagggcagcctttgga

SEQ ID NO: 181 - protein, 379 aa, Glycine max
  Glyma02g00960.1 polypeptide
MGRHSCCYKQKLRKGLWSPEEDEKLLRHITKYGHGCWSSVPKQAGLQRCGKSCRLRWINYLRPDLKRGTFSQEEENLIIELHAVLGNRWSQIAAQLPGRTDNEIKNLWNSCLKKKLRQKGIDPVTHKPLSEVENGEKAAEVSNELNLLKSESSNRQESYTTSCQPSDLMGNFPIQMSYATNDQCLPNDSNSSHWFSQTGRSFDMNTEFPFNAAVTSINPTPTTNLFLPNNSFCYKPSLAVPSDNVSIPYGSHYWEASASNNSNSSTELRSSSPLNIFSSWGLADCGTSTTKEAQIHMMENHNTEEAKWDEYLHNPISMLASSVQNQAPESLCNDIKTSMHLVPDTLGAMLPHNHTKQQEQSQTSSFFSKDIQKLRAAFG

SEQ ID NO: 182 - DNA, 585 bp, Vitis vinifera
  GSVIVT01028235001
atggggaggcactcttgttgttacaagcagaagctaaggaaaggcctatggtctcctgaagaagatgagaaacttctgaggcatattaccaagtatggccatggctgctggagctctgtcccaaagcaagcaggtctgcaaaggtgtgggaagagctgcagattgaggtggattaactacttgaggcctgatttgaagagaggcacattctccctacaggaagagaatcttataattgagcttcattcagttcttgggaacaggtggtcccaaatcgcagcacagctgcctggacgcactgacaatgaaataaagaatttgtggaactcttgcttgaagaagaagctcaggcagagaggcattgaccccaacacccacaaacccctctctgaggttgaaaatagagaagacagcaaccctcccaccgacagccaggacaaagcttcaggagtatccagtgaattgaacctcctcaagacaataaacagcaacaacaacaataacagcaacagcaatttgatgctgccaaccatcagatgtggtggggtatttggcccctcagcaattgaattacccatccaatgc

SEQ ID NO: 183 - protein, 195 aa, Vitis vinifera
  GSVIVT01028235001 polypeptide
MGRHSCCYKQKLRKGLWSPEEDEKLLRHITKYGHGCWSSVPKQAGLQRCGKSCRLRWINYLRPDLKRGTFSLQEENLIIELHSVLGNRWSQIAAQLPGRTDNEIKNLWNSCLKKKLRQRGIDPNTHKPLSEVENREDSNPPTDSQDKASGVSSELNLLKTINSNNNNNSNSNLMLPTIRCGGVFGPSAIELPIQC

SEQ ID NO: 184 - DNA, 1278 bp, Zea mays
  GRMZM2G171781_T01
atggggaggcattcttgctgctacaagcagaagctgagaaaggggctctggtcccctgaggaggatgagaaactcatgaatcacataacaaagcatggccatggctgctggagctctgttcccaaactcgctgggcttcaaaggtgcggaaagagttgtaggctgaggtggataaactatctgaggccagacctcaagagaggggcattcgcccaagacgaagaagacctcatcatcgagctgcacgctgtcctcgggaacaggtggtctcaaattgcagcgcagctgccagggaggactgataatgagatcaagaatctatggaactcgtgcatcaagaagaagctgaggcagaaaggcattgatcccaacacccacaagccacttactgaggctgatcgcggcggtgcagctcccaccatcagcaccgagagaacctcagggtccagcgacgtcaacccatcaagcactggtcctctggggaacttgagccccctcctcagcgagacggctcaatcatcaatgctgatgcccgtgtacgacaagaatcgtgctgaaacaccaaacttggcacgccctaagctgccaccaaaggagctgttcctggagcagcttactgctggacatgagagtccatcaacctgccactcatcaggccaaactctctatttccctttccaacagcctttaggctacaacagtgagagtggcagcagcgatggggcgaatatgaattcactctggttcaaccagagtgacttcaactgcagcacaatttctacagtgatgccgccagtttcaccatcggccctctctacatcaatggggctgaatcttccacctgataatcctcgacatggaggaactggcattggaagtaccgcagtagattcattctactgggatggtactaatcctagcagcagtagcagtactgggagcagagggagcaacagtatgggatttgaaccacagagcacgagcacaattctggagaacagtgtcttcccatggacagacattggacaagaaaaagatacaagggctcacctagttgcggaacttaagtggcctgactcctttgccgagacgaccacagccatgcagaaccagagccaaacgctttatgatgatgtgatcaaggcagagagccaattcaacatagaagggatatgtgcttcttggttccagaatcagcagccacagcaacagctgcaggtagcaccagacatgtatgacaaggacttgcaaagaatgcaactatcttttgagaatatc

SEQ ID NO: 185 - protein, 426 aa, Zea mays
  GRMZM2G171781_T01 polypeptide
MGRHSCCYKQKLRKGLWSPEEDEKLMNHITKHGHGCWSSVPKLAGLQRCGKSCRLRWINYLRPDLKRGAFAQDEEDLIIELHAVLGNRWSQIAAQLPGRTDNEIKNLWNSCIKKKLRQKGIDPNTHKPLTEADRGGAAPTISTERTSGSSDVNPSSTGPLGNLSPLLSETAQSSMLMPVYDKNRAETPNLARPKLPPKELFLEQLTAGHESPSTCHSSGQTLYFPFQQPLGYNSESGSSDGANMNSLWFNQSDFNCSTISTVMPPVSPSALSTSMGLNLPPDNPRHGGTGIGSTAVDSFYWDGTNPSSSSSTGSRGSNSMGFEPQSTSTILENSVFPWTDIGQEKDTRAHLVAELKWPDSFAETTTAMQNQSQTLYDDVIKAESQFNIEGICASWFQNQQPQQQLQVAPDMYDKDLQRMQLSFENI

SEQ ID NO: 186 - DNA, 1290 bp, Setaria italica
  Si022112m
atggggaggcattcttgctgctacaagcaaaagttgagaaaggggctctggtctccggaggaggatgagaaactcatgaatcacataacaaagcatggccatggctgctggagttctgttcccaaactcgcagggctccaaaggtgcggaaagagttgcaggctgaggtggataaactatttgaggccagacctcaagagaggggcattctctcaagaggaagaagacctcatcattgagctgcatgctgtccttggcaacaggtggtctcaaattgcagcacagctgcctggaaggactgacaacgagatcaagaacctatggaactcatgcatcaagaagaaactgaggcagaaaggcattgatcccaacacccacaagccgcttgctgaggctgattgcagcggagcagctcccaccatcagcactgagaggacctcaggatccagcgacgtcaacccatcaagcactggtgctctggggaacttgagccacctcctcagcgagacagctcaatcatcaatgctgctgccagtgtatgacaagaatcaccctgaaactccaaacttagcacgccctaaggtgcctccaaaggagttatttctggaccagcttactgctggacacgagagttcatcaacctgccgctcatcaggccaaacgttgtatttcccttttcaacagccattaggctacagcagtgagagtggcagtggtgacggtgcaagtatgaactcactctggttcaaccagaatgacttcaactgcagcacaatttccactgtgatgccaccagtttcaccatcagccctatcaacatcgatggggctgaatctcccaccaaataatcctcgacatggaggcactggcattggaagtgcctcagtagattcattatactgggatggtacaaatcctagcagcagtagcagtactgggagcagaggaagcaacagtttgggatttgaaccacagagcacaagctcaattctggagaacagtgtgttcccatggacagacgtcggacaagaaaaagattcaagagctcacttagtagaggaacttaagtggcctgacttgctccatggaacctttgctgaaacgaccgtagccatgcaggaccagagccaatcactctatgatgacgtgatcaaggcagagagccaattcaacatggaagggatatgtgcttcttggtaccagaatcagcagccacagcaacagctgcaggcagcaccagacatgtatgacaaggacctgcaaagaatgcaactgtcttttgagaatatc

SEQ ID NO: 187 - protein, 430 aa, Setaria italica
  Si022112m polypeptide
MGRHSCCYKQKLRKGLWSPEEDEKLMNHITKHGHGCWSSVPKLAGLQRCGKSCRLRWINYLRPDLKRGAFSQEEEDLIIELHAVLGNRWSQIAAQLPGRTDNEIKNLWNSCIKKKLRQKGIDPNTHKPLAEADCSGAAPTISTERTSGSSDVNPSSTGALGNLSHLLSETAQSSMLLPVYDKNHPETPNLARPKVPPKELFLDQLTAGHESSSTCRSSGQTLYFPFQQPLGYSSESGSGDGASMNSLWFNQNDFNCSTISTVMPPVSPSALSTSMGLNLPPNNPRHGGTGIGSASVDSLYWDGTNPSSSSSTGSRGSNSLGFEPQSTSSILENSVFPWTDVGQEKDSRAHLVEELKWPDLLHGTFAETTVAMQDQSQSLYDDVIKAESQFNMEGICASWYQNQQPQQQLQAAPDMYDKDLQRMQLSFENI

SEQ ID NO: 188 - DNA, 1287 bp, Brachypodium distachyon
  Bradi2g11080.1
atggggaggcattcctgctgttacaagcagaagctgaggaaggggctctggtctcctgaggaggatgagaaactcctgaaccatataaacaagcatgggcacggctgctggagcactgtcccaaaacttgcagggcttcagaggtgtggcaagagctgtaggctgaggtggatgaactacctgagacctgacttgaaaagaggtgcattcgaacaggaggaagaagacctcatcatcgaactccatgctgtcctagggaacaagtggtctcaaattgcaacacggctggctggaagaactgacaatgagatcaagaatctttggaactcgtgcatcaagaagaagctgcggcagaaaggcctcgaccccaacactcacaagccccttgctgatgaagctgatcgcaggaaagtagctcccaccatgagtactgaaaggacctccgagtctagcgatgtcgaccagtccagtgctggtgcccttggcaacttgagccatcttctcactgagacggcacaatcaccagagctcctgccagtgcttggtaagcagcgcgccaaaactccaagcttgacatgtgtgaaggtgccacccaaggagttttttctcgaccagctggcttctggtcatgagagccttcccagctgccattcatcactccccatgcccaacttccctttccagcagccaccttgctacagcaatggatttagcagcagggatggtggaagcaagaactcactctggtggtttaaccagaatgagtccagtggcagcgcgatttccactgtgatgccgccagtttcaccatcaactctctcaacatccacagtgctcaatctgtcaccagacaatccacattctggaggcactggcatccacagtgcccaattctactgggatactgctaatcctagcagcagttgcagtacgcgaagcagcggaaataataacttgggtttcgagctgcaaagcacaagctcgcttctagagaacagcgtcttcccatgggcagagttagcacaagataaagatagccaagttcacctagaggaagaactcaagtggcctgagttgctccatggtaccttcccagagacatcaacagcaatgcagaaccttagccaatcgctgtacgaagacgtggttaaggccgaaagccaattcaacatggaggggctctgtgcagcttggtctcaaaatctgcagccacaacaacatctccagctagtaacagatatgtatgacaaggatttgcaaagaatgtcatcaccttttgagaatatc

SEQ ID NO: 189 - protein, 429 aa, Brachypodium distachyon
  Bradi2g11080.1 polypeptide
MGRHSCCYKQKLRKGLWSPEEDEKLLNHINKHGHGCWSTVPKLAGLQRCGKSCRLRWMNYLRPDLKRGAFEQEEEDLIIELHAVLGNKWSQIATRLAGRTDNEIKNLWNSCIKKKLRQKGLDPNTHKPLADEADRRKVAPTMSTERTSESSDVDQSSAGALGNLSHLLTETAQSPELLPVLGKQRAKTPSLTCVKVPPKEFFLDQLASGHESLPSCHSSLPMPNFPFQQPPCYSNGFSSRDGGSKNSLWWFNQNESSGSAISTVMPPVSPSTLSTSTVLNLSPDNPHSGGTGIHSAQFYWDTANPSSSCSTRSSGNNNLGFELQSTSSLLENSVFPWAELAQDKDSQVHLEEELKWPELLHGTFPETSTAMQNLSQSLYEDVVKAESQFNMEGLCAAWSQNLQPQQHLQLVTDMYDKDLQRMSSPFENI

SEQ ID NO: 190 - DNA, 1281 bp, Oryza sativa
  LOC_Os05g04820.1
atggggaggcattcttgctgctacaagcagaaattgaggaaggggctctggtcccctgaggaggatgagaagctcatgaatcacataaccaagcatggccatggctgctggagttctgttcctaaacttgcagggctccaaagatgcggcaagagctgcaggctgaggtggataaactatctgaggcctgacctcaagagaggtgcattctctcaggaggaagaagacctcatcattgagctccatgctgtccttgggaacaggtggtctcagattgcagctcagctgcctgggaggactgacaacgagatcaagaatctctggaattcttgcatcaagaagaagctccggcagaaaggcattgatcccaacacccacaagcccctcaccgaggctgatcgcaggggagcagcacccacagtcagcaccgagaggacctcagggtccagcgacgtcaacccgtcaagtgctggtgctctagggaacttgagccacctcctcagcgagacagcacaatcatcaatgctgctgccggtgtatgataagaatcaccctgaaactgcaagcttgccacgccctaaggtgccaccaaaggagttgtttcttgaccagcttactgccggtcacgagagcccatcaagttgccgctcatcaggtccaaccctgtattttcctttccagcaaccattaggctacagtaatgaatgtggcactggggatggtgcgagtatgaattcactctggttcaaccagaatgatttcaactgcagcacaatctccaccgtgatgccaccagtttcaccatcagccctctcaacatcaatggggctgaatcttcccccagaaaatcctcgtcacggaggcactggcattggcaacaccccgttctactgggatggttccaatcctagcagcagcggcagtactgggagcagcggaagcaacagtatgggattcgagccacagagcacaacctcaattttggagaacagtgtattcccatggacagatatcggacaagagaaagataccagagttcacttagtggaggaactcaagtggcctgatttgctccatggaacctttgctgaggcgacgacagccatgcagaaccagagccaatcattatacgatgatgtgatcaaggcagagagccaattcaacatggaagggatatgtgcctcttggttccagaatcagcaaccacaacaacagctgcaagcagcatcagacatgtatgataaagacttgcaaagattgcccttgtcttttgaacatatc

SEQ ID NO: 191 - protein, 427 aa, Oryza sativa
  LOC_Os05g04820.1 polypeptide
MGRHSCCYKQKLRKGLWSPEEDEKLMNHITKHGHGCWSSVPKLAGLQRCGKSCRLRWINYLRPDLKRGAFSQEEEDLIIELHAVLGNRWSQIAAQLPGRTDNEIKNLWNSCIKKKLRQKGIDPNTHKPLTEADRRGAAPTVSTERTSGSSDVNPSSAGALGNLSHLLSETAQSSMLLPVYDKNHPETASLPRPKVPPKELFLDQLTAGHESPSSCRSSGPTLYFPFQQPLGYSNECGTGDGASMNSLWFNQNDFNCSTISTVMPPVSPSALSTSMGLNLPPENPRHGGTGIGNTPFYWDGSNPSSSGSTGSSGSNSMGFEPQSTTSILENSVFPWTDIGQEKDTRVHLVEELKWPDLLHGTFAEATTAMQNQSQSLYDDVIKAESQFNMEGICASWFQNQQPQQQLQAASDMYDKDLQRLPLSFEHI

SEQ ID NO: 192 - DNA, 1167 bp, Vitis vinifera
  GSVIVT01031341001
atggggaggcactcttgctgctacaagcagaagctgaggaaaggcctgtggtctcccgaggaagatgagaaacttctgatgcatattaccaagtatggacatgggtgttggagctccgtccctaaactagcaggtttgcagaggtgtgggaagagctgcaggctaagatggattaactacttgaggcctgatttgaagaggggagcattctcacaacaggaagagagcctgataattgaactccatgcagttctaggcaacagatggtcgcagattgcagctcaattaccgggaagaacggataatgaaataaaaaatttgtggaactcctgcattaagaagaagcttagacaaaaaggcatcgaccccaacactcacaaaccgcttgtggaggctgagaacggacaagataagctgcctaattccgataaaagcaatgaaaaagccaatgaactgaaccttgttgaggccgagaatttaaagccactttcaactgctgcggagcagccttctggcttggtggggcatttctcttttcagcagttgaattatgggcccaatattgggctctcatccagaactgggaagtcggcaccttcagtaataatgccagcagcagcaatgggagcaggaacagtgatcctgaagacatcaaatggtctgagtatctccataccccatttctattgggcaccacactacagaaccaaagccctcaacctatctatagtgagactaagccaggaatacatttcacaacagatgggtcaagtactggctggcatcagaaccagcaggaacaacccatacaagcttcagctgacatatataccaaggatctccagagacttggtgtggcttttggacagatttgttaacttgtatttaacatgtggagcctctaattcaagggacgagagaatcacggggggttttcagtccaagaaggatttggaaaaaacatcttctggtcaggtgtgtgctatagaattttcttatgattttgtaaataggtctgatacaaaagggctgagctatttcttaatgaatatttgtaatggaaacaagcttctgttcatcttttttcatgggagtatggtatggaataaggtttcttttgatgtctattcctcttctatgcttcatttgtttcggattcataggttg

SEQ ID NO: 193 - protein, 389 aa, Vitis vinifera
  GSVIVT01031341001 polypeptide
MGRHSCCYKQKLRKGLWSPEEDEKLLMHITKYGHGCWSSVPKLAGLQRCGKSCRLRWINYLRPDLKRGAFSQQEESLIIELHAVLGNRWSQIAAQLPGRTDNEIKNLWNSCIKKKLRQKGIDPNTHKPLVEAENGQDKLPNSDKSNEKANELNLVEAENLKPLSTAAEQPSGLVGHFSFQQLNYGPNIGLSSRTGKSAPSVIMPAAAMGAGTVILKTSNGLSISIPHFYWAPHYRTKALNLSIVRLSQEYISQQMGQVLAGIRTSRNNPYKLQLTYIPRISRDLVWLLDRFVNLYLTCGASNSRDERITGGFQSKKDLEKTSSGQVCAIEFSYDFVNRSDTKGLSYFLMNICNGNKLLFIFFHGSMVWNKVSFDVYSSSMLHLFRIHRL

SEQ ID NO: 194 - DNA, 1338 bp, Citrus clementina
  clementine0.9_010206m
atggggaggcactcttgttgttacaagcagaagctaaggaaaggtttgtggtcacccgaagaagatgagaagcttttgaggcatattactaagtatggccatggttgctggagctctgtccccaagcaagctggtttacagagatgtggtaagagttgcagacttagatggattaattatttgaggcctgatttgaagagaggcacattctcacagcaagaagagaaccttataattgagcttcatgcagttctggggaatagatggtctcagattgcggcacaactgcccggtagaaccgacaatgaaataaagaatctgtggaattcttgcttaaagaagaagctcaggcagagaggcattgaccctgtaacgcataagccactttctgaagttgaaaatggagaagacaagaatcaaacaacaaacagccaagacaaagtctctggggtatctggtgaattgaacctcctcaacactgagcttaccgcaaagcatgggacaacggcagctttaaatgagcagaaaccaacttcagttactgcacaagcctaccatttgtcggaaatacaaggctcttcaatccccagcacagtcaacaacaatagaagcaatttttatacacacagatttgcaagttccaaccaagaaagcagcagcatcaccaatagccagccttcagattttgtggggcattttcctcttcaacaattgaattgtgcttccaatgcaagactttcaacagcagcctcaaattcccctctctggtttatgcaaaccagtaaatcattcgatataaattctcaattctcgtccaatgcaatgcccacaatcctgccccctgtatctagctcatcattattttcagctcctatgagctacaaaacatctgtcactcttccctcagataatcattcgataccctcttttacggtcaatggatcccggtactgggaagccggtggtgcctcaaacagcaacagtgtaagcagtagcagcacagagctgcagagcaccagctccttccttgagagcagcatcttcccttggggactagcagattgcagctcatcagagaaagaaggtcaaatcaatcttattgatagccaccctgacgatgttaagtggccagaatatttccaaaccccatcattgctaatggccgctgctttgcaaaatcaaacttctcaatccttatacaatgagataaaatctgaaacacatttcctgactgatagctcgagtggtatatggcctcaaaaccagcaacaacctttacaaaattctgacatatgtgctaaggagatccagagacttactgcaacgtatggacatatt

SEQ ID NO: 195 - protein, 446 aa, Citrus clementina
  clementine0.9_010206m polypeptide
MGRHSCCYKQKLRKGLWSPEEDEKLLRHITKYGHGCWSSVPKQAGLQRCGKSCRLRWINYLRPDLKRGTFSQQEENLIIELHAVLGNRWSQIAAQLPGRTDNEIKNLWNSCLKKKLRQRGIDPVTHKPLSEVENGEDKNQTTNSQDKVSGVSGELNLLNTELTAKHGTTAALNEQKPTSVTAQAYHLSEIQGSSIPSTVNNNRSNFYTHRFASSNQESSSITNSQPSDFVGHFPLQQLNCASNARLSTAASNSPLWFMQTSKSFDINSQFSSNAMPTILPPVSSSSLFSAPMSYKTSVTLPSDNHSIPSFTVNGSRYWEAGGASNSNSVSSSSTELQSTSSFLESSIFPWGLADCSSSEKEGQINLIDSHPDDVKWPEYFQTPSLLMAAALQNQTSQSLYNEIKSETHFLTDSSSGIWPQNQQQPLQNSDICAKEIQRLTATYGHI

SEQ ID NO: 196 - DNA, 1044 bp, Arabidopsis thaliana
  AT4G01680.2
atgggaagacattcatgttgttacaaacagaaactgaggaaaggactttggtctcctgaagaagatgagaagcttcttcgttacatcactaagtatggtcatggttgctggagctctgtccctaaacaagctggtacgtttttatttatccaaattcatcttttgtttggtttacagagatgtggaaaaagttgtagattaagatggataaattatttaagaccagatttgaagagaggagcattttctcaagatgaagaaaatctcattattgaacttcatgccgttcttggcaatagatggtctcagatagctgcacagcttcctggaagaaccgacaatgaaatcaagaatctttggaattcttgtttgaagaagaaattgaggctgagaggaattgacccggttacacacaagctcttaaccgaaatcgaaaccggtacagatgacaaaacaaaaccggttgagaagagtcaacagacctacctcgttgagactgatggctcctctagtaccactacttgtagtactaaccaaaacaacaacactgatcatctttataccggaaatttcggttttcaacggttaagtctagaaaacggttcaagaatcgcagccggttctgacctcggtatctggattccccaaaccggaagaaaccatcatcatcatgtcgatgaaaccatccctagtgcagtggtactacccggttcaatgttctcatccggtttaaccggttatagatcctccaatctcggtttaattgaattggaaaactcattctcaaccgggccaatgatgacagagcatcagcaaattcaagagagtaactacaacaattcaacattctttggaaatgggaatctgaattggggattaacaatggaggaaaatcaaaatccattcacaatatcgaatcattcaaattcgtccttatacagtgatataaaatcagagaccaatttttttggcacagaggctacaaatgttggtatgtggccatgtaaccagctccagcctcagcaacatgcatatggccatata

SEQ ID NO: 197 - protein, 348 aa, Arabidopsis thaliana
  AT4G01680.2 polypeptide
MGRHSCCYKQKLRKGLWSPEEDEKLLRYITKYGHGCWSSVPKQAGTFLFIQIHLLFGLQRCGKSCRLRWINYLRPDLKRGAFSQDEENLIIELHAVLGNRWSQIAAQLPGRTDNEIKNLWNSCLKKKLRLRGIDPVTHKLLTEIETGTDDKTKPVEKSQQTYLVETDGSSSTTTCSTNQNNNTDHLYTGNFGFQRLSLENGSRIAAGSDLGIWIPQTGRNHHHHVDETIPSAVVLPGSMFSSGLTGYRSSNLGLIELENSFSTGPMMTEHQQIQESNYNNSTFFGNGNLNWGLTMEENQNPFTISNHSNSSLYSDIKSETNFFGTEATNVGMWPCNQLQPQQHAYGHI

SEQ ID NO: 198 - DNA, 1281 bp, Zea mays
  GRMZM2G017520_T01
atggggaggcactcctgctgttacaagcagaagctgaggaaggggctctggtctcctgaggaagatgagaagctcatgaaccacataaccaagcacgggcatggctgctggagcactgtccccaagcttgcagggcttcagaggtgtggcaagagctgcaggctgaggtggataaattacctgaggcctgaccttaaaagaggcgcattctctgaggaggaggaagacctcatcgtcgaacttcatgctgtactggggaacaggtggtctcagattgcaacaaggttgcctggaagaactgacaacgagattaagaatctctggaactcgagcatcaagaagaagctccggcagaaaggcattgaccccaacacccacaagccgctccttgtcgaggttgaacgcagcaaagcagctccaacgaccagtaccgagaggacctctgagtccagtgatgttgacccttcaagtggcggcgcacttggcaactcgagccatcttcttctcagcgagacagcacaatcaccacagctgccagcgctcggtaagcatcgcagagaaactactagcctcgcacatctaagggtgccgcccaaggagttgttccttgaccagctggtttctggtcatgagaacctcactggctgccgcacagcaggcccagttccaaatttccctttccaacagctcatgtgctacagcaatgaatttggcaacaagaatggtgctagtaacaattcactctggtttaaccacaatgagacaagtggcagcaccatttccactgtgatgccaccagtttcgccatcaactctctcaacatcaacagggctcaataggtcaccagacaacccacactcgggaggcactggtattcagagcacccagttctactgggacactgctaatcctagcagctgcagcagtagaggaagcagcggaagcaacggcttgggatttgagctgcaaagcacaagctcgcttctggagagtagtgttttcccatggacagaattaacaccagacaaaaatagccaagttcaccttggggaagaactcaagtggcccgacttgctccacggaacattcacggacacacctgcaaccatgcagaatcttagccagtcactgtacgaagatgttatcaaagccgagagccaattcaacatagagggcctctgtgcagcctggtctcaaaatctgcagccacagcaacatctgcaggtatcagatttgtatgacaaggatttgcaaaggatgtccttgtcttttgagaatatc

SEQ ID NO: 199 - protein, 427 aa, Zea mays
  GRMZM2G017520_T01 polypeptide
MGRHSCCYKQKLRKGLWSPEEDEKLMNHITKHGHGCWSTVPKLAGLQRCGKSCRLRWINYLRPDLKRGAFSEEEEDLIVELHAVLGNRWSQIATRLPGRTDNEIKNLWNSSIKKKLRQKGIDPNTHKPLLVEVERSKAAPTTSTERTSESSDVDPSSGGALGNSSHLLLSETAQSPQLPALGKHRRETTSLAHLRVPPKELFLDQLVSGHENLTGCRTAGPVPNFPFQQLMCYSNEFGNKNGASNNSLWFNHNETSGSTISTVMPPVSPSTLSTSTGLNRSPDNPHSGGTGIQSTQFYWDTANPSSCSSRGSSGSNGLGFELQSTSSLLESSVFPWTELTPDKNSQVHLGEELKWPDLLHGTFTDTPATMQNLSQSLYEDVIKAESQFNIEGLCAAWSQNLQPQQHLQVSDLYDKDLQRMSLSFENI

SEQ ID NO: 200 - DNA, 1242 bp, Eucalyptus grandis
  Eucgr.A00996.1
atggggaggcattcttgctgttacaagcagaagctcagaaaaggcttatggtcacctgaagaggatgagaagcttctgaggcatatctctcagtatggccatggttgttggagctctgtcccaaagcaagccggtctacagagatgcggcaagagctgcagattgaggtggattaattacttgaggcccgatttgaaaagaggggcgttctcgcaagatgaagaggacctcattattgagctccacgctgctcttgggaacaagtggtcgcagattgcagcaaacttgcctggcagaactgacaatgagataaagaacctgtggaattcttgcctgaagaaaaagctcaggcagagaggcattgaccctgtgagccacaggcctctctctgaggttgagaatagtgacgacaaggacgcaacgtcagggcagacccaagataaggtctctcgtgggtcagttgaattgctgagccagctcaatccacaattctcaagctccacgacagcaaggagcagtaaaaacagcaatttgatggcaccaacattgagcaaggacacagttgcagatgggtttgtgagcaatcaccaagagaactcgatgatgaacagttgcatctcagactttgttgataatttctctctgcaacaattgaactactcatcaagtgattccagattttctaatctctgtttcacccaaacgggcagagcacatggaaacaccatcttttccgacttcaattcgaatgtaatatctgccatttctcctccctcatctaactctttattccctactgcttcaatgggcttcaacttcaagccatctaatgctgtcccctcggcgaattcgacttcaagcgctagcacaggaactgcagattttcacaacagtggctcctacttcgggaacagcttagtttcctggggattgttagcagattgtggctcgccagacaaggagggatcgacttcgatccatccattggaagttcaccaacccggagacttcaagtgggctgccgaatatctccagaaccctctgttcatggcggccgcgctgcagaaccaagcccaggaacagtccaatttgtacaatcagataaagccagagacccagtttcctccagaccattcaactacttccatgtgggatcatctacagggacatgaatccttggacaattctttgaatacgtgcggcaaggatatccagagattaacggcgctactcggacacaat

SEQ ID NO: 201 - protein, 414 aa, Eucalyptus grandis
  Eucgr.A00996.1 polypeptide
MGRHSCCYKQKLRKGLWSPEEDEKLLRHISQYGHGCWSSVPKQAGLQRCGKSCRLRWINYLRPDLKRGAFSQDEEDLIIELHAALGNKWSQIAANLPGRTDNEIKNLWNSCLKKKLRQRGIDPVSHRPLSEVENSDDKDATSGQTQDKVSRGSVELLSQLNPQFSSSTTARSSKNSNLMAPTLSKDTVADGFVSNHQENSMMNSCISDFVDNFSLQQLNYSSSDSRFSNLCFTQTGRAHGNTIFSDFNSNVISAISPPSSNSLFPTASMGFNFKPSNAVPSANSTSSASTGTADFHNSGSYFGNSLVSWGLLADCGSPDKEGSTSIHPLEVHQPGDFKWAAEYLQNPLFMAAALQNQAQEQSNLYNQIKPETQFPPDHSTTSMWDHLQGHESLDNSLNTCGKDIQRLTALLGHN

SEQ ID NO: 202 - DNA, 1194 bp, Solanum lycopersicum
  Solyc10g044680.1.1
atggggaggccttgctgttacaaaaagaagctgaggaaaggcctttggtgccctgaggaagatgagaaacttataaatcatgtaactaaatatggtcatggttgttggagttcagtccctaaactagccgctcttcagaggtgtggaaagagctgcagacttaggtggattaactacttgagacctgacctcaaaagaggaacattctcacaacaagaagagaatttgatcattcaacttcattcacttttagggaacaagtggtctcagattgcttctagattacctggaagaaccgacaatgaaatcaagaacttatggaactcttctattaagaagaaactaaggcaaaaagggattgatccaaacactcataaacttctatccgtaattgagaatgaagagaaggtatcagcaatcagtatgaatattgagaaagtctctgaaggctcaagtgaactgaatattattgaggattccaactacagaattaaatcaaagtcatctttagtgacaatgactatggacaactatcctagtaatacgactacttctgcagcgccactaacacacaaattctttcttgaaaggtttgttaccacacacgaaacctccaccgctagctgcaataagcctcttgatcagttgacaagttacctctcctttgagaaattgaattatggttcaaacattggcttgtccataaattcaaacaccaacaatctccttttaaactccaagaattcagaaatgtttactcatcaggtcaattctagcatcacaaatgataatattctgacatctccaatagcagcaatagcaagtaatgattcaatgcgcaatggaagcagtactagtattgaattgcaaaggaactcttctttcttcgatagcaatgccttctcctggggaactgcagattatgataaatcagaaaaagaagtcaatattcatccctccgtacctgatcctgatgacatcaaatggtctgagtatctccatacacaacttttaccaggcaatgcaatcaccaatgatcaaataactcaagatttatacagtgcaaaatcaagcatacaattcacaacacaaggttcattgctacagaaccaacaacaacagccttctttacaaactgcaaacatctacaataagcactatcagagaatttcagattcctttggacagttttca

SEQ ID NO: 203 - protein, 398 aa, Solanum lycopersicum
  Solyc10g044680.1.1 polypeptide
MGRPCCYKKKLRKGLWCPEEDEKLINHVTKYGHGCWSSVPKLAALQRCGKSCRLRWINYLRPDLKRGTFSQQEENLIIQLHSLLGNKWSQIASRLPGRTDNEIKNLWNSSIKKKLRQKGIDPNTHKLLSVIENEEKVSAISMNIEKVSEGSSELNIIEDSNYRIKSKSSLVTMTMDNYPSNTTTSAAPLTHKFFLERFVTTHETSTASCNKPLDQLTSYLSFEKLNYGSNIGLSINSNTNNLLLNSKNSEMFTHQVNSSITNDNILTSPIAAIASNDSMRNGSSTSIELQRNSSFFDSNAFSWGTADYDKSEKEVNIHPSVPDPDDIKWSEYLHTQLLPGNAITNDQITQDLYSAKSSIQFTTQGSLLQNQQQQPSLQTANIYNKHYQRISDSFGQFS

SEQ ID NO: 204 - DNA, 1290 bp, Zea mays
  GRMZM2G127490_T01
atggggaggcattcttgctgctacaagcaaaagttgagaaaggggctctggtcccccgaggaggatgagaaactcatgaaccacataacaaagcatggccatggctgctggagttctattcccaaactcgctgggctccaaaggtgcggaaagagttgtaggctgaggtggataaactatctgaggccagacctcaagagaggggcattctcccaagacgaagaagacctcatcattgagctgcacgctgtccttggaaacaggtggtctcaaattgcagctcagctgccagggaggactgataatgagatcaagaatctatggaactcgtgcatcaagaagaagctcaggcagaaaggcattgatcccaacacccacaagccccttactgaggctgatcgcagcggagcagctcccaccatcagcaccgagagaacctcagggtccagcgaaatcaacccatcaagcgctggtgctctgggaaacttgagccacctcctcagcgagacggctcaatcatcaatgctgatgcccgtgtatgacaagaatcgcgctgaaactccaaacttggcacgccctaaggtgccaccaaaggagttgttcctggagcagcttactgctggacacgagagtccatcaacctgccgctcatcaggccaaactctctatttccctttccaacagcctttaggctacaacagtgagagtggcagtggcgatggggcgaatatgaattcactctggttcaaccagagtgacttcaactgcagcacaatttctacagtgatgccgccagcttcaccatcggccctctctacatcaatggggctgaatcttccacctgataattctcgacatggaggaactggcattggaagtactgcagtagattcattctactgggatggtactaatcctagcagcagtagcagtactgggagcagaggaagcaacagtatgggatttgaaccacagagcacgagctcaattctggagaacagtgtcttccaatggacagacatcggacaagaaaaagatacaagagctcacctggtagaggaacttaagtggcctgacttgctccatggaacctttgccgagacgaccacagccatgcagaaccagagccagacgctctatgatgacgtgatcaaggcagagagccaattcagcatggaagggatatgtgcttcttggttccagaatcagcagccacagcaacagcttcaggcaacaccagacatgtatgacaaggacttgcaaagaatgcaactgtcttttgagaatatc

SEQ ID NO: 205 - protein, 430 aa, Zea mays
  GRMZM2G127490_T01 polypeptide
MGRHSCCYKQKLRKGLWSPEEDEKLMNHITKHGHGCWSSIPKLAGLQRCGKSCRLRWINYLRPDLKRGAFSQDEEDLIIELHAVLGNRWSQIAAQLPGRTDNEIKNLWNSCIKKKLRQKGIDPNTHKPLTEADRSGAAPTISTERTSGSSEINPSSAGALGNLSHLLSETAQSSMLMPVYDKNRAETPNLARPKVPPKELFLEQLTAGHESPSTCRSSGQTLYFPFQQPLGYNSESGSGDGANMNSLWFNQSDFNCSTISTVMPPASPSALSTSMGLNLPPDNSRHGGTGIGSTAVDSFYWDGTNPSSSSSTGSRGSNSMGFEPQSTSSILENSVFQWTDIGQEKDTRAHLVEELKWPDLLHGTFAETTTAMQNQSQTLYDDVIKAESQFSMEGICASWFQNQQPQQQLQATPDMYDKDLQRMQLSFENI

SEQ ID NO: 206 - DNA, 1290 bp, Setaria italica; identical to SEQ ID NO: 186
  Si022113m

SEQ ID NO: 207 - protein, 430 aa, Setaria italica; identical to SEQ ID NO: 187
  Si022113m polypeptide

SEQ ID NO: 208 - DNA, 1305 bp, Eucalyptus grandis
  Eucgr.K00555.1
atggggaggcactcttgctgctacaagcagaagctgaggaaaggcctctggtcacctgaagaagacgagaagctcctcaggtacatcacgcagtatggccatggttgctggagctctgttcctaagcttgcaggtctgcagaggtgtgggaagagctgcagattgaggtggattaactacctgaggcctgatttgaagaggggcacattctctcaagaagaggaggacctcatcattgaacttcatgcagttctggggaacaggtggtctcagattgcggcgcaattgcctggaagaactgacaatgaaatcaagaacctgtggaactcttgcctgaagaagaagctgaggcaaaagggtatcgaccctgccactcacaagcccctctctgaggttgaacatggtggcgatgacaagagcacgacacccaaaagccacgaaagagccgcattctccgggtcctcaaatggtctgtcccagacccaacaagctcccaattcagagaacactctgcttgagcattgttccagttcaaacgccaacaatagcagcaagatcagcaatctgatgaattctagtcttgacaaagactgcttcccaaatgggcttctgagctccacctccagttgtcagccttctgatgatttggtgggtcatttcccacttcagccactgggaaattacgcgtccatttcaaggctctcagaagcaatctccaaccatagtccttggttcggacaaagcggcaaaagtttcagcataaacacggaattcggctgcagcacgatgcctgccatccttccgcattcaaacatttcatttcaccatgacccagtaggctttagacctgccatgaccgttccgaatgataattactgtttcaagccgttcacagtcgatgaatccagatattgggaagtcaatgctcctaccagtagcggtgcggcgaatgcagaattgttaggcagtggctcgtacttcgagaatagtatgctctcttggggactagagaattgcaacacaatggggaaagaagccgatatgaacaatcctccgggcggccatatcggggatatcaagttgcccgattactttcacgacccactattgataggagccgcttcacaacaccaagcgccgcaatctctgtacaacgagatcaagccggacactcattttgataccaattatagctcaagcgccatgtggcttcaaaatcagcaagaccaaggacttttgccatcatctgatacatcatcatgtcctaagaacatccaaagacttactgctctctttggacacatt

SEQ ID NO: 209 - protein, 435 aa, Eucalyptus grandis
  Eucgr.K00555.1 polypeptide
MGRHSCCYKQKLRKGLWSPEEDEKLLRYITQYGHGCWSSVPKLAGLQRCGKSCRLRWINYLRPDLKRGTFSQEEEDLIIELHAVLGNRWSQIAAQLPGRTDNEIKNLWNSCLKKKLRQKGIDPATHKPLSEVEHGGDDKSTTPKSHERAAFSGSSNGLSQTQQAPNSENTLLEHCSSSNANNSSKISNLMNSSLDKDCFPNGLLSSTSSCQPSDDLVGHFPLQPLGNYASISRLSEAISNHSPWFGQSGKSFSINTEFGCSTMPAILPHSNISFHHDPVGFRPAMTVPNDNYCFKPFTVDESRYWEVNAPTSSGAANAELLGSGSYFENSMLSWGLENCNTMGKEADMNNPPGGHIGDIKLPDYFHDPLLIGAASQHQAPQSLYNEIKPDTHFDTNYSSSAMWLQNQQDQGLLPSSDTSSCPKNIQRLTALFGHI

SEQ ID NO: 210 - protein, 48 aa, Arabidopsis thaliana
  AT1G57560.1 amino acids 14-61, Myb-like DNA binding domain
KGLWSPEEDEKLLNYITKHGHGCWSSVPKLAGLERCGKSCRLRWINYL

SEQ ID NO: 211 - protein, 46 aa, Arabidopsis thaliana
  AT1G57560.1 amino acids 67-112, Myb-like DNA-binding domain
RGAFSSEEQNLIVELHAVLGNRWSQIAARLPGRTDNEIKNLWNSCI

SEQ ID NO: 212 - protein, 48 aa, Arabidopsis thaliana
  AT1G09540.1 amino acids 14-61, Myb-like DNA-binding domain
KGLWSPEEDEKLLTHITNHGHGCWSSVPKLAGLQRCGKSCRLRWINYL

SEQ ID NO: 213 - protein, 46 aa, Arabidopsis thaliana
  AT1G09540.1 amino acids 67-112, Myb-like DNA-binding domain
RGAFSPEEENLIVELHAVLGNRWSQIASRLPGRTDNEIKNLWNSSI

SEQ ID NO: 214 - protein, 48 aa, Arabidopsis thaliana
  AT5G26660.1 amino acids 14-61, Myb-like DNA-binding domain
KGLWSPEEDEKLLNYITRHGHGCWSSVPKLAGLQRCGKSCRLRWINYL

SEQ ID NO: 215 - protein, 46 aa, Arabidopsis thaliana
  AT5G26660.1 amino acids 67-112, Myb-like DNA-binding domain
RGAFSQDEESLIIELHAALGNRWSQIATRLPGRTDNEIKNFWNSCL

SEQ ID NO: 216 - protein, 48 aa, Glycine max
  Glyma10g28250.1 amino acids 14-61, Myb-like DNA-binding domain
KGLWSPEEDEKLLNHITKHGHGCWSSVPKLAGLQRCGKSCRLRWINYL

SEQ ID NO: 217 - protein, 46 aa, Glycine max
  Glyma10g28250.1 amino acids 67-112, Myb-like DNA-binding domain
RGAFSQQEENMIVELHAVLGNRWSQIAAQLPGRTDNEIKNLWNSCL

SEQ ID NO: 218 - protein, 48 aa, Populus trichocarpa
  POPTR_0013s00290.1 14-61, Myb-like DNA-binding domain
KGLWSPEEDEKLLNYITKHGLGCWSSVPKLAGLQRCGKSCRLRWINYL

SEQ ID NO: 219 - protein, 46 aa, Populus trichocarpa
  POPTR_0013s00290.1 amino acids 67-112, Myb-like DNA binding domain
RGAFSQQEENLIIELHAVLGNRWSQIAAQLPGRTDNEIKNLWNSCI

SEQ ID NO: 220 - protein, 48 aa, Vitis vinifera
  GSVIVT01017716001 amino acids 14-61, Myb-like DNA-binding domain
RGLWSPEEDEKLFRYITEHGHGCWSSVPKQAGLQRCGKSCRLRWINYL

SEQ ID NO: 221 - protein, 46 aa, Vitis vinifera
  GSVIVT01017716001 amino acids 67-112, Myb-like DNA-binding domain
RGAFTGQEEKLIVELHEILGNRWSQIASHLPGRTDNEIKNQWNSSI

SEQ ID NO: 222 - protein, 48 aa, Glycine max
  Glyma03g38660.1 amino acids 14-61, Myb-like DNA-binding domain
KGLWSPEEDEKLLNYITKHGHGCWSSVPKLAGLQRCGKSCRLRWINYL

SEQ ID NO: 223 - protein, 46 aa, Glycine max
  Glyma03g38660.1 amino acids 67-112, Myb-like DNA-binding domain
RGAFSQQEENSIVELHAVLGNRWSQIAAQLPGRTDNEIKNLWNSCL

SEQ ID NO: 224 - protein, 48 aa, Eucalyptus grandis
  Eucgr.B01827.1 amino acids 67-114, Myb-like DNA-binding domain
KGLWSPEEDEKLLNYIAKFGLGCWSSVPKLAGLQRCGKSCRLRWINYL

SEQ ID NO: 225 - protein, 46 aa, Eucalyptus grandis
  Eucgr.B01827.1 amino acids 120-165, Myb-like DNA-binding domain
RGAFSQQEESLIIELHAVLGNRWSQIAAHLPGRTDNEIKNLWNSGL

SEQ ID NO: 226 - protein, 48 aa, Eucalyptus grandis
  Eucgr.H01337.1 amino acids 14-61, Myb-like DNA-binding domain
KGLWSPEEDEKLLNYITTYGHGCWSAVPKLAGLQRCGKSCRLRWINYL

SEQ ID NO: 227 - protein, 46 aa, Eucalyptus grandis
  Eucgr.H01337.1 amino acids 67-112, Myb-like DNA-binding domain
RGAFSHQEENLIIELHAVLGNRWSQIAARLPGRTDNEIKNFWNSSL

SEQ ID NO: 228 - protein, 76 aa, Citrus clementina
  clementine0.9_009770m amino acids 14-89, Myb-like DNA binding domain
KGLWSPEEDEKLLNYITKHGHGCWSSVPKLAGKIYLENNNHACSVILMFNAFNTMFLLAGLQRCGKSCRLRWINYL

SEQ ID NO: 229 - protein, 46 aa, Citrus clementina
  clementine0.9_009770m amino acids 95-140, Myb-like DNA binding domain
RGAFSVQEESLIVELHAVLGNRWSQIAAQLPGRTDNEIKNLWNSSI

SEQ ID NO: 230 - protein, 48 aa, Populus trichocarpa
  POPTR_0005s00340.1 amino acids 14-61, Myb-like DNA-binding domain
KGLWSPEEDEKLLNYITKHGHGCWSSVPKQADLQRCGKSCRLRWINYL

SEQ ID NO: 231 - protein, 46 aa, Populus trichocarpa; identical to SEQ ID NO: 219
  POPTR_0005s00340.1 amino acids 67-112, Myb-like DNA-binding domain

SEQ ID NO: 232 - protein, 48 aa, Glycine max; identical to SEQ ID NO: 222
  Glyma20g22230.1 amino acids 14-61, Myb-like DNA-binding domain

SEQ ID NO: 233 - protein, 46 aa, Glycine max; identical to SEQ ID NO: 217
  Glyma20g22230.1 amino acids 67-112, Myb-like DNA-binding domain

SEQ ID NO: 234 - protein, 48 aa, Glycine max; identical to SEQ ID NO: 222
  Glyma19g41250.1 amino acids 14-61, Myb-like DNA-binding domain

SEQ ID NO: 235 - protein, 46 aa, Glycine max
  Glyma19g41250.1 amino acids 67-112, Myb-like DNA-binding domain
RGAFSQQEENSIIELHAVLGNRWSQIAAQLPGRTDNEIKNLWNSCL

SEQ ID NO: 236 - protein, 48 aa, Solanum lycopersicum
  Solyc01g102340.2.1 amino acids 14-61, Myb-like DNA-binding domain
KGLWSPEEDEKLIKHITKFGHGCWSSVPKLAGLQRCGKSCRLRWINYL

SEQ ID NO: 237 - protein, 46 aa, Solanum lycopersicum
  Solyc01g102340.2.1 amino acids 67-112, Myb-like DNA-binding domain
RGTFSQDEENLIIELHAVLGNKWSQIAARLPGRTDNEIKNLWNSSI

SEQ ID NO: 238 - protein, 48 aa, Glycine max
  Glyma19g41010.1 amino acids 14-61, Myb-like DNA-binding domain
KGLWSPEEDEKLLRHITKYGHGCWSSVPKQAGLQRCGKSCRLRWINYL

SEQ ID NO: 239 - protein, 46 aa, Glycine max
  Glyma19g41010.1 amino acids 67-112, Myb-like DNA-binding domain
RGTFSQEEETLIIELHAVLGNRWSQIAAQLPGRTDNEIKNLWNSCL

SEQ ID NO: 240 - protein, 48 aa, Oryza sativa
  LOC_Os01g18240.1 amino acids 14-61, Myb-like DNA-binding domain
KGLWSPEEDEKLMNHITKHGHGCWSTVPKLAGLQRCGKSCRLRWINYL

SEQ ID NO: 241 - protein, 46 aa, Oryza sativa
  LOC_Os01g18240.1 amino acids 67-112, Myb-like DNA-binding domain
RGAFSQEEEDLIVELHAVLGNRWSQIATRLPGRTDNEIKNLWNSCI

SEQ ID NO: 242 - protein, 48 aa, Setaria italica; identical to SEQ ID NO: 240
  Si001565m amino acids 14-61, Myb-like DNA-binding domain

SEQ ID NO: 243 - protein, 46 aa, Setaria italica
  Si001565m amino acids 67-112, Myb-like DNA-binding domain
RGAFSQEEEDLIIELHAVLGNRWSQIATRLPGRTDNEIKNLWNSSI

SEQ ID NO: 244 - protein, 48 aa, Brachypodium distachyon
  Bradi2g36730.1 amino acids 14-61, Myb-like DNA-binding domain
KGLWSPEEDEKLMNHITKHGHGCWSSVPKLAGLQRCGKSCRLRWINYL

SEQ ID NO: 245 - protein, 46 aa, Brachypodium distachyon
  Bradi2g36730.1 amino acids 67-112, Myb-like DNA-binding domain
RGAFAQDEEDLIIELHAVLGNRWSQIAAQMPGRTDNEIKNLWNSSL

SEQ ID NO: 246 - protein, 48 aa, Setaria italica
  Si029872m amino acids 102-149, Myb-like DNA-binding domain
RGLWSPEEDEKLMNHIAKYGHGCWSSVPKLAGLERCGKSCRLRWINYL

SEQ ID NO: 247 - protein, 46 aa, Setaria italica
  Si029872m amino acids 155-200, Myb-like DNA-binding domain
RGAFSQEEEDLIIHLHSMLGNKWSQIAAQLPGRTDNEVKNFWNSYI

SEQ ID NO: 248 - protein, 48 aa, Populus trichocarpa; identical to SEQ ID NO: 238
  POPTR_0014s10680.1 amino acids 14-61, Myb-like DNA-binding domain

SEQ ID NO: 249 - protein, 46 aa, Populus trichocarpa
  POPTR_0014s10680.1 amino acids 67-112, Myb-like DNA-binding domain
RGTFSQQEENLIIELHAVLGNRWSQIAAQLPGRTDNEIKNLWNSCL

SEQ ID NO: 250 - protein, 48 aa, Populus trichocarpa
  PPOPTR_0002s18700.1 amino acids 14-61, Myb-like DNA-binding domain
KGLWSPEEDEKLLSHITKYGHGCWSSVPKQAGLQRCGKSCRLRWINYL

SEQ ID NO: 251 - protein, 46 aa, Populus trichocarpa
  POPTR_0002s18700.1 amino acids 67-112, Myb-like DNA-binding domain
RGTFSHLEENLIIELHAVLGNRWSQIAAQLPGRTDNEIKNLWNSCL

SEQ ID NO: 252 - protein, 48 aa, Eucalyptus grandis
  Eucgr.B02197.1 amino acids 14-61, Myb-like DNA-binding domain
KGLWSPEEDEKLVRHIVKYGHGCWSSVPKLAGLQRCGKSCRLRWINYL

SEQ ID NO: 253 - protein, 46 aa, Eucalyptus grandis
  Eucgr.B02197.1 amino acids 67-112, Myb-like DNA-binding domain
RGTFSQQEEDLIIELHAVLGNRWSQIASQLPGRTDNEIKNLWNSSI

SEQ ID NO: 254 - protein, 48 aa, Zea mays
  GRMZM2G147698_T01 amino acids 14-61, Myb-like DNA-binding domain
RGLWSPEEDEKLMNHIAKYGHGCWSSVPKLAGLDRCGKSCRLRWINYL

SEQ ID NO: 255 - protein, 46 aa, Zea mays
  GRMZM2G147698_T01 amino acids 67-112, Myb-like DNA-binding domain
RGTFSQEEEDLIIHLHSLLGNKWSQIAAQLPGRTDNEVKNFWNSYI

SEQ ID NO: 256 - protein, 48 aa, Glycine max; identical to SEQ ID NO: 238
  Glyma02g00960.1 amino acids 14-61, Myb-like DNA-binding domain

SEQ ID NO: 257 - protein, 46 aa, Glycine max
  Glyma02g00960.1 amino acids 67-112, Myb-like DNA-binding domain
RGTFSQEEENLIIELHAVLGNRWSQIAAQLPGRTDNEIKNLWNSCL

SEQ ID NO: 258 - protein, 48 aa, Vitis vinifera; identical to SEQ ID NO: 238
  GSVIVT01028235001 amino acids 14-61, Myb-like DNA-binding domain

SEQ ID NO: 259 - protein, 46 aa, Vitis vinifera
  GSVIVT01028235001 amino acids 67-112, Myb-like DNA-binding domain
RGTFSLQEENLIIELHSVLGNRWSQIAAQLPGRTDNEIKNLWNSCL

SEQ ID NO: 260 - protein, 48 aa, Zea mays; identical to SEQ ID NO: 244
  GRMZM2G171781_T01 amino acids 14-61, Myb-like DNA-binding domain

SEQ ID NO: 261 - protein, 46 aa, Zea mays
  GRMZM2G171781_T01 amino acids 67-112, Myb-like DNA-binding domain
RGAFAQDEEDLIIELHAVLGNRWSQIAAQLPGRTDNEIKNLWNSCI

SEQ ID NO: 262 - protein, 48 aa, Setaria italica; identical to SEQ ID NO: 244
  Si022112m amino acids 14-61, Myb-like DNA-binding domain

SEQ ID NO: 263 - protein, 46 aa, Setaria italica
  Si022112m amino acids 67-112, Myb-like DNA-binding domain
RGAFSQEEEDLIIELHAVLGNRWSQIAAQLPGRTDNEIKNLWNSCI

SEQ ID NO: 264 - protein, 48 aa, Brachypodium distachyon
  Bradi2g11080.1 amino acids 14-61, Myb-like DNA-binding domain
KGLWSPEEDEKLLNHINKHGHGCWSTVPKLAGLQRCGKSCRLRWMNYL

SEQ ID NO: 265 - protein, 46 aa, Brachypodium distachyon
  Bradi2g11080.1 amino acids 67-112, Myb-like DNA-binding domain
RGAFEQEEEDLIIELHAVLGNKWSQIATRLAGRTDNEIKNLWNSCI

SEQ ID NO: 266 - protein, 48 aa, Oryza sativa; identical to SEQ ID NO: 244
  LOC_Os05g04820.1 amino acids 14-61, Myb-like DNA-binding domain

SEQ ID NO: 267 - protein, 46 aa, Oryza sativa; identical to SEQ ID NO: 263
  LOC_Os05g04820.1 amino acids 67-112, Myb-like DNA-binding domain

SEQ ID NO: 268 - protein, 48 aa, Vitis vinifera
  GSVIVT01031341001 amino acids 14-61, Myb-like DNA-binding domain
KGLWSPEEDEKLLMHITKYGHGCWSSVPKLAGLQRCGKSCRLRWINYL

SEQ ID NO: 269 - protein, 46 aa, Vitis vinifera
  GSVIVT01031341001 amino acids 67-112, Myb-like DNA-binding domain
RGAFSQQEESLIIELHAVLGNRWSQIAAQLPGRTDNEIKNLWNSCI

SEQ ID NO: 270 - protein, 48 aa, Citrus clementina; identical to SEQ ID NO: 238
  clementine0.9_010206m amino acids 14-61, Myb-like DNA binding domain

SEQ ID NO: 271 - protein, 46 aa, Citrus clementina; identical to SEQ ID NO: 249
  clementine0.9_010206m amino acids 67-112, Myb-like DNA binding domain

SEQ ID NO: 272 - protein, 60 aa, Arabidopsis thaliana
  AT4G01680.2 amino acids 14-73, Myb-like DNA-binding domain
KGLWSPEEDEKLLRYITKYGHGCWSSVPKQAGTFLFIQIHLLFGLQRCGKSCRLRWINYL

SEQ ID NO: 273 - protein, 46 aa, Arabidopsis thaliana
  AT4G01680.2 amino acids 79-124, Myb-like DNA-binding domain
RGAFSQDEENLIIELHAVLGNRWSQIAAQLPGRTDNEIKNLWNSCL

SEQ ID NO: 274 - protein, 48 aa, Zea mays; identical to SEQ ID NO: 240
  GRMZM2G017520_T01 amino acids 14-61, Myb-like DNA-binding domain

SEQ ID NO: 275 - protein, 46 aa, Zea mays
  GRMZM2G017520_T01 amino acids 67-112, Myb-like DNA-binding domain
RGAFSEEEEDLIVELHAVLGNRWSQIATRLPGRTDNEIKNLWNSSI

SEQ ID NO: 276 - protein, 48 aa, Eucalyptus grandis
  Eucgr.A00996.1 amino acids 14-61, Myb-like DNA-binding domain
KGLWSPEEDEKLLRHISQYGHGCWSSVPKQAGLQRCGKSCRLRWINYL

SEQ ID NO: 277 - protein, 46 aa, Eucalyptus grandis
  Eucgr.A00996.1 amino acids 67-112, Myb-like DNA-binding domain
RGAFSQDEEDLIIELHAALGNKWSQIAANLPGRTDNEIKNLWNSCL

SEQ ID NO: 278 - protein, 48 aa, Solanum lycopersicum
  Solyc10g044680.1.1 amino acids 13-60, Myb-like DNA-binding domain
KGLWCPEEDEKLINHVTKYGHGCWSSVPKLAALQRCGKSCRLRWINYL

SEQ ID NO: 279 - protein, 46 aa, Solanum lycopersicum
  Solyc10g044680.1.1 amino acids 66-111, Myb-like DNA-binding domain
RGTFSQQEENLIIQLHSLLGNKWSQIASRLPGRTDNEIKNLWNSSI

SEQ ID NO: 280 - protein, 48 aa, Zea mays
  GRMZM2G127490_T01 amino acids 14-61, Myb-like DNA-binding domain
KGLWSPEEDEKLMNHITKHGHGCWSSIPKLAGLQRCGKSCRLRWINYL

SEQ ID NO: 281 - protein, 46 aa, Zea mays
  GRMZM2G127490_T01 amino acids 67-112, Myb-like DNA-binding domain
RGAFSQDEEDLIIELHAVLGNRWSQIAAQLPGRTDNEIKNLWNSCI

SEQ ID NO: 282 - protein, 48 aa, Setaria italica; identical to SEQ ID NO: 244
  Si022113m amino acids 14-61, Myb-like DNA-binding domain

SEQ ID NO: 283 - protein, 46 aa, Setaria italica; identical to SEQ ID NO: 263
  Si022113m amino acids 67-112, Myb-like DNA-binding domain

SEQ ID NO: 284 - protein, 48 aa, Eucalyptus grandis
  Eucgr.K00555.1 amino acids 14-61, Myb-like DNA-binding domain
KGLWSPEEDEKLLRYITQYGHGCWSSVPKLAGLQRCGKSCRLRWINYL

SEQ ID NO: 285 - protein, 46 aa, Eucalyptus grandis
  Eucgr.K00555.1 amino acids 67-112, Myb-like DNA-binding domain
RGTFSQEEEDLIIELHAVLGNRWSQIAAQLPGRTDNEIKNLWNSCL

SEQ ID NO: 286 - DNA, 963 bp, Glycine max
  Glyma05g37460.1
atgggtcaccattcttgctgcaaccaacagaaggttaaaagaggactttggtctcctgaggaagatgaaaaactcatcagatacattactactcatggatatggctgttggggtgaagttccagaaaaagctgggcttctaaggtgtggcaagagttgtcgcctgagatggattaattatttaagacccgatattagaagaggcaggtttacacctgaggaggagaagttaattataactcttcacggggtcgtgggaaacagatgggctcacattgcaagccacttgcctggtcgaactgacaatgaaataaagaactattggaactcatggataaaaaagaagataagaaagacttcggtgtcttcaaccaccattgcacaaagtatcgatcacaattcttcccaccagttcaattacaattccaatctagtactagaccactttcccaaccaagataacaatctacaaacaaaacctccagttcaagaagccttgttttcctcaacatgccctctgttcatatttgacactactgattcactagaacctggcacagcaacagactgcaagagtagtactgtgcgagcagaacattttcatcaagatgctgtgggtttgagcagtgaaacatggaactcgagccaccatcaggttcatgcacttccacctctcacagtgagtgtaggtttggacaccagcaattatttgccaccattgattgagcacgtggacaacatggtcccaattgaggtacaatcatgtactatcgatgagcaaggagatatagcactagagtgcttgcagaggcaagggttaaatgaatgggtggaaacgcagcaacaatgtcctaattttcttttttgggacagtgttgaaggacaacttggtggggaagaactagcaccaaattcatcaaatgtggaagcaaatacgctttctccttttccttgttctttgtga

SEQ ID NO: 287 - protein, 320 aa, Glycine max
  Glyma05g37460.1 polypeptide
MGHHSCCNQQKVKRGLWSPEEDEKLIRYITTHGYGCWGEVPEKAGLLRCGKSCRLRWINYLRPDIRRGRFTPEEEKLIITLHGVVGNRWAHIASHLPGRTDNEIKNYWNSWIKKKIRKTSVSSTTIAQSIDHNSSHQFNYNSNLVLDHFPNQDNNLQTKPPVQEALFSSTCPLFIFDTTDSLEPGTATDCKSSTVRAEHFHQDAVGLSSETWNSSHHQVHALPPLTVSVGLDTSNYLPPLIEHVDNMVPIEVQSCTIDEQGDIALECLQRQGLNEWVETQQQCPNFLFWDSVEGQLGGEELAPNSSNVEANTLSPFPCSL

SEQ ID NO: 288 - DNA, 966 bp, Glycine max
  Glyma08g02080.1
atgggtcaccattcttgctgcaaccaacagaaggttaaaagaggactttggtctcctgaggaagatgaaaagctcatcagatacattactactcatggatatggctgttggagtgaagttccagaaaaagctgggcttcaaaggtgtggcaagagttgtcgcttgagatggattaattatttaagacccgatattagaagagggaggtttacacctgaggaggagaagttaattataagccttcacggggtcgtaggaaacagatgggctcacattgcaagccacttgccaggtcgaactgacaatgaaataaagaactattggaactcatggataaaaaagaaaataagaaagacttcttcggtgtcttcaacaaccattgcacaaagtatcgatcacaattcttctgaccagttcaattacaattccaatctagtactagaccactttcccaaccatgataacaatctacaaacaaaaccaccagttcaagaaaccttgttttcctcaacatgccctctgttcatgtttgacactactagttcactagaagctggcacagcaatagactgcaatagtactactgtgcgagcagaacattttcaagatgctgtgggtttgagcactgaaacatggaacttgagccaccatcaggttcatgcacttccacctctcacagtgagtgtaggtttggacaccacaaattatttgccaccattgattgagaacgtggacaacatggtcccaattgaggtacaatcttgtaccatggatgagcaaggagatatagcactagagtgcttgcagaggcgaggcttaaatgaatggatggtggagacgcagcaacaatgtcctaactttcttttttgggacagtgttgaaggacagcttggtggggaagaactagcaccaaattcatcaaatgtggaagcaaatatgctttctccttttccttcttctttgtga

SEQ ID NO: 289 - protein, 321 aa, Glycine max
  Glyma08g02080.1 polypeptide
MGHHSCCNQQKVKRGLWSPEEDEKLIRYITTHGYGCWSEVPEKAGLQRCGKSCRLRWINYLRPDIRRGRFTPEEEKLIISLHGVVGNRWAHIASHLPGRTDNEIKNYWNSWIKKKIRKTSSVSSTTIAQSIDHNSSDQFNYNSNLVLDHFPNHDNNLQTKPPVQETLFSSTCPLFMFDTTSSLEAGTAIDCNSTTVRAEHFQDAVGLSTETWNLSHHQVHALPPLTVSVGLDTTNYLPPLIENVDNMVPIEVQSCTMDEQGDIALECLQRRGLNEWMVETQQQCPNFLFWDSVEGQLGGEELAPNSSNVEANMLSPFPSSL

SEQ ID NO: 290 - DNA, 978 bp, Glycine max
  Glyma11g02400.1
atgggtcaccattcttgctgcaaccaacagaaggttaagagaggactttggtcccccgaggaagatgagaaactcatcagatacatcaccactcacggctatggttgctggagtgaagttccagagaaagctgggcttcaaaggtgtggtaagagttgtcgcctgagatggattaattatttgaggcctgatattagaagaggcaggtttacacctgaagaggagaagttaattataagtcttcatggggtcgttggcaacagatgggctcacattgcaagccacttaccaggtagaactgacaacgaaataaagaactattggaattcttggatcaaaaagaaaattagaaagccttctacggtgacttcatcaatcaccactacacaaagtgttgatcaccagctccaattcaattttaattccaatcaactagatcactatggcaaccaagaaaatgtaacagcaaagccaccggtgcaagaaaccttattttcctcgacgtgccccctatttatgtttgacactagttcattagatcaagggacaacaactgtagacaccaccaataatgtacgagcagaactgttccaagattcattgggtttgagcagtagtgaaacgtggaacatgagccaccatcaagtccatgctcttcctcctcaactagcagcaacttttacagcaacaaacgttattgatactacgaattatctgccaccattgatagagaacgttgaaaacatggtgccaaatatggaagtacagtcttgtagtatagacgaggaaggagaaatggcactagagtgtttgcggagacaagatttgaatgagtgggtggagaatcaacaacaatgtcccagctttcttttctgggacaatattaatgttgaaggacaacttcgaggggaagaactagcaccaaacacgtcaaatatgggaaacaatacactttcaccttttccttcctctttatga

SEQ ID NO: 291 - protein, 325 aa, Glycine max
  Glyma11g02400.1 polypeptide
MGHHSCCNQQKVKRGLWSPEEDEKLIRYITTHGYGCWSEVPEKAGLQRCGKSCRLRWINYLRPDIRRGRFTPEEEKLIISLHGVVGNRWAHIASHLPGRTDNEIKNYWNSWIKKKIRKPSTVTSSITTTQSVDHQLQFNFNSNQLDHYGNQENVTAKPPVQETLFSSTCPLFMFDTSSLDQGTTTVDTTNNVRAELFQDSLGLSSSETWNMSHHQVHALPPQLAATFTATNVIDTTNYLPPLIENVENMVPNMEVQSCSIDEEGEMALECLRRQDLNEWVENQQQCPSFLFWDNINVEGQLRGEELAPNTSNMGNNTLSPFPSSL

SEQ ID NO: 292 - DNA, 981 bp, Glycine max
  Glyma01g43120.1
atgggtcaccattcttgctgcaaccaacagaaggttaagagaggcctttggtcccccgaggaagatgagaagctcatcagatacattaccactcacggctatggttgctggagtgaagttccagagaaagctgggcttcaaaggtgtggtaagagttgtcgcctgagatggattaattatttgaggcctgatattagaagaggcaggtttacacctgaagaggagaagttaattataagtcttcatggggtcgttggcaacagatgggctcacattgcaagccacttaccaggtagaactgacaacgaaataaagaactactggaattcttggatcaaaaagaaaattagaaagccttcttcggtgacttcatcaatgaccactacacaaagtgttgatcatcaccacccccagttcaattataattccaatcaactagatcactatggccaccaagaaaatttaacagcaaagccaccgatgcaagaaaccttattttcctcgacgtgccccctatttatgtttgacactagttcattagatcaagggacaacaacagtagacaccaccaccaatgtacgaacagaattgttccaagattcattgggtttgagcagtactgaaacgtggaacttgagccaccatcaagtccatgttcttcctcctcaactagcagcaacttttacagcagcaacagttattgataccacgaattatctgccaccattgatagagaacgtggacaacatggtgccaaatatggaagtacagtcttgtagtatagacgaggaaggagaaatggcactagagtgtctacggagacaaggtttgaatgagtgggtggagcatcaacaacaatgtcccaactttcttttctgggacagtattaatgtagaaggacaacttggaggggaagaactagcaccaaacacgtcaaatatgggaaacaatacactttcaccttttccatcctctttatga

SEQ ID NO: 293 - protein, 326 aa, Glycine max
  Glyma01g43120.1 polypeptide
MGHHSCCNQQKVKRGLWSPEEDEKLIRYITTHGYGCWSEVPEKAGLQRCGKSCRLRWINYLRPDIRRGRFTPEEEKLIISLHGVVGNRWAHIASHLPGRTDNEIKNYWNSWIKKKIRKPSSVTSSMTTTQSVDHHHPQFNYNSNQLDHYGHQENLTAKPPMQETLFSSTCPLFMFDTSSLDQGTTTVDTTTNVRTELFQDSLGLSSTETWNLSHHQVHVLPPQLAATFTAATVIDTTNYLPPLIENVDNMVPNMEVQSCSIDEEGEMALECLRRQGLNEWVEHQQQCPNFLFWDSINVEGQLGGEELAPNTSNMGNNTLSPFPSSL

SEQ ID NO: 294 - DNA, 915 bp, Vitis vinifera
  GSVIVT01019410001
atgggtcaccattcttgctgcaatcaacagaaggtaaagagggggctttggtcccctgaggaagacgaaaagctcatcagatacatcaccacctatggctatggttgttggagtgaagtccctgagaaagctgggctacaaagatgcggcaaaagctgccgcctgaggtggatcaactacttgagacccgatatcagaagagggaggttcaccccagaggaggagaaactgattatcaaccttcatggggttgtaggcaatagatgggctcatattgcaagtcacttgcctggaagaacagacaatgagataaagaattactggaattcgtggatcaaaaagaagataaggaagccgtcggcacctctagcatcatctataacaaacactgagcattcccaattgggctacggttcgagccaactggacatggtgaatcaagatttgatgatgaagcagcctgctcaagaaaccctattttcttctcctgctcctctatttatgttcgacactggttcactagacttgatcggggatggcaatggacgaacggagcttttccaggaagtggcaggcttgagttcagaaacatggcagctgaaccagcatcaagttgaagcactacctcctccagcatcttattcagttggcatggatactaattatttgcctccattggtagagaacatagagaacatggtgcccatgcaggtgcaatcttgtagcatcgacgaggagggagagatagcactggagtgcttacagaggcaggagttgaatgactgggttgaatcccaacagtgcccaagctttctattctgggatcaagttgaaggacaccttggaggagaagagattgcaccaccttcatccaacatgggagctgtgttatcgtcttactcgacatctctataa

SEQ ID NO: 295 - protein, 304 aa, Vitis vinifera
  GSVIVT01019410001 polypeptide
MGHHSCCNQQKVKRGLWSPEEDEKLIRYITTYGYGCWSEVPEKAGLQRCGKSCRLRWINYLRPDIRRGRFTPEEEKLIINLHGVVGNRWAHIASHLPGRTDNEIKNYWNSWIKKKIRKPSAPLASSITNTEHSQLGYGSSQLDMVNQDLMMKQPAQETLFSSPAPLFMFDTGSLDLIGDGNGRTELFQEVAGLSSETWQLNQHQVEALPPPASYSVGMDTNYLPPLVENIENMVPMQVQSCSIDEEGEIALECLQRQELNDWVESQQCPSFLFWDQVEGHLGGEEIAPPSSNMGAVLSSYSTSL

SEQ ID NO: 296 - DNA, 1113 bp, Arabidopsis thaliana
  AT1G63910.1
atgggtcatcactcatgctgcaaccagcaaaaggtgaagagagggctttggtcaccggaagaagatgagaagcttattagatatatcacaactcatggctatggatgttggagtgaagtccctgaaaaagcagggcttcaaagatgtggaaaaagttgtagattgcgatggataaactatcttcgacctgatatcaggagaggaaggttctctccagaagaagagaaattgatcataagccttcatggagttgtgggaaacaggtgggctcatatagctagtcatttaccgggaagaacagataacgagattaaaaactattggaattcatggattaagaaaaagatacgaaaaccgcaccatcattacagtcgtcatcaaccgtcagtaactactgtgacattgaatgcggacactacatcgattgccactaccatcgaggcctctaccaccacaacatcgactatcgataacttacattttgacggtttcactgattctcctaaccaattaaatttcaccaatgatcaagaaactaatataaagattcaagaaacttttttctcccataaacctcctctcttcatggtagacacaacacttcctatcctagaaggaatgttctctgaaaacatcatcacaaacaataacaagaacaatgatcatgatgacacgcaaagaggaggaagagaaaatgtttgtgaacaagcatttctaacaactaacacggaagaatgggatatgaatcttcgtcagcaagagccgtttcaagttcctacactggcgtcacatgtgttcaacaactcttccaattcaaatattgacacggttataagttataatctaccggcgctaatagagggaaatgtcgataacatcgtccataatgaaaacagcaatgtccaagatggagaaatggcgtccacattcgaatgtttaaagaggcaagaactaagctatgatcaatgggacgattcacaacaatgctctaactttttcttttgggacaaccttaatataaacgtggaaggttcatctcttgttggaaaccaagacccatcaatgaatttgggatcatctgccttatcttcttctttcccttcttcgttttaa

SEQ ID NO: 297 - protein, 370 aa, Arabidopsis thaliana
  AT1G63910.1 polypeptide
MGHHSCCNQQKVKRGLWSPEEDEKLIRYITTHGYGCWSEVPEKAGLQRCGKSCRLRWINYLRPDIRRGRFSPEEEKLIISLHGVVGNRWAHIASHLPGRTDNEIKNYWNSWIKKKIRKPHHHYSRHQPSVTTVTLNADTTSIATTIEASTTTTSTIDNLHFDGFTDSPNQLNFTNDQETNIKIQETFFSHKPPLFMVDTTLPILEGMFSENIITNNNKNNDHDDTQRGGRENVCEQAFLTTNTEEWDMNLRQQEPFQVPTLASHVFNNSSNSNIDTVISYNLPALIEGNVDNIVHNENSNVQDGEMASTFECLKRQELSYDQWDDSQQCSNFFFWDNLNINVEGSSLVGNQDPSMNLGSSALSSSFPSSF

SEQ ID NO: 298 - DNA, 1056 bp, Zea mays
  GRMZM2G325907_T01
atggggcatcactcctgctgcaaccagcagaaggtgaagagggggctctggtcccctgaggaggacgagaagctcatcaggtacatcaccacccatggctacgggtgctggagcgaggtccccgagaaggccggcctacaacgctgcgggaagagctgccggctgcggtggatcaactacctcaggccggacatccgccgaggccggttcacggcggaggaggagaagctcatcatcagcctgcacgccattgttggcaacaggtgggcccacattgccagccacttgcccgggcggacggacaacgagatcaagaactactggaactcgtggatcaagaagaagatccggaagccggcgatgagcacgacgacgacgagctcggccgtgacggcggcgagccctccgtgcagcacggcggcgtcggacgcggcgcttggtcgtcacctgcagacgccgttcagcgcggcggagcaccggctcgacgccatcctcagccagagccttgccttgccgccgccgaagctgggctccggcggcggcggcggcggcggccaagagtccccgccgctgcccccgcactgccccttcttcatgttcgacacgagcgtcagcgtcagcccgccgtcgcccgcggccgctgcagcacaccacctgcagcacccgttcctcactttcacggcggcggcgatggacgacaacgcgccgatgggcttccatctgccgcccttggtggacggcatgggaatgggcatgccagcagccatggactgcggcgctctaggccatgaccaccgcgttgccggcggcaacaacaatggtcaggcggcggcggcggcggccggcatggcgaacggctgctgctacgggcagctgcagaagcagcaggaggaggagcagcagccgtcgctggggcaggaggaccagtgggacgacgagtcggcgcggcacctgctgatgtgggacgatgaccaagaactaacaccgtccaacctggaagccatggaaagtacagctcactccctcctttttatgggaccaaatgaccatacatga

SEQ ID NO: 299 - protein, 351 aa, Zea mays
  GRMZM2G325907_T01 polypeptide
MGHHSCCNQQKVKRGLWSPEEDEKLIRYITTHGYGCWSEVPEKAGLQRCGKSCRLRWINYLRPDIRRGRFTAEEEKLIISLHAIVGNRWAHIASHLPGRTDNEIKNYWNSWIKKKIRKPAMSTTTTSSAVTAASPPCSTAASDAALGRHLQTPFSAAEHRLDAILSQSLALPPPKLGSGGGGGGGQESPPLPPHCPFFMFDTSVSVSPPSPAAAAAHHLQHPFLTFTAAAMDDNAPMGFHLPPLVDGMGMGMPAAMDCGALGHDHRVAGGNNNGQAAAAAAGMANGCCYGQLQKQQEEEQQPSLGQEDQWDDESARHLLMWDDDQELTPSNLEAMESTAHSLLFMGPNDHT

SEQ ID NO: 300 - DNA, 1080 bp, Oryza sativa
  LOC_Os08g05520.1
atggggcatcactcttgctgcaaccagcagaaggtgaagaggggcctctggtctcctgaggaagatgagaagctcatcagatacatcaccacccatggctatggctgctggagcgaggtcccggagaaagccggtttgcagcgatgtgggaagagctgccggctccggtggatcaactacctgagaccggacatccggcgagggcggttcacggcggaggaggagaagctcatcatcagcctgcacgccattgttggcaacaggtgggcccacattgccagccacctgcctggccggaccgacaacgagatcaagaactactggaattcatggatcaagaagaagattcgcaagccggcggcggccgccgccgcggcgaccacgacgagcccgaacaacccgccgccgtgcagcacggcgacgtcggaccaccaccacctgccgccgccggcgttcggcggcgctgatcaccacctgcagctcgacgccatcatcaaccagaacctgatatcatccctgccgccgaagctcgccaccggcgacgactcgccgccggcggtgcccgggctgccgcaccactgcccgctcttcatgttcgacaccaccaccaccggcgccggcggcgccatcagcccgccgccgccgtcatcactgatcccaacccacctccaccaccaccaccacccgttcatcgccagcttcacggcggcgatggccgccgacacgccgagctacctgcccccgctggtcgacggcatggcagccatgggagcggccatggattgcagcttagaagatggccaaacagccgccgccatggccgccaccaatggctactaccagcatcatcagaagcatcagcagctggagattgagctggaggaggaggagcagaggcagctagggcatcatcatcatcagcatcaccatgagcatgagcatgaaaatcatcagtgggatgaagaagaagcacagcatctgctgatgtgggatcaagaagtactaacatcatccaacttggaggccatgcaaagtggtgctcattccctcctttttatgggaccaaatgaccatgattaa

SEQ ID NO: 301 - protein, 359 aa, Oryza sativa
  LOC_Os08g05520.1 polypeptide
MGHHSCCNQQKVKRGLWSPEEDEKLIRYITTHGYGCWSEVPEKAGLQRCGKSCRLRWINYLRPDIRRGRFTAEEEKLIISLHAIVGNRWAHIASHLPGRTDNEIKNYWNSWIKKKIRKPAAAAAAATTTSPNNPPPCSTATSDHHHLPPPAFGGADHHLQLDAIINQNLISSLPPKLATGDDSPPAVPGLPHHCPLFMFDTTTTGAGGAISPPPPSSLIPTHLHHHHHPFIASFTAAMAADTPSYLPPLVDGMAAMGAAMDCSLEDGQTAAAMAATNGYYQHHQKHQQLEIELEEEEQRQLGHHHHQHHHEHEHENHQWDEEEAQHLLMWDQEVLTSSNLEAMQSGAHSLLFMGPNDHD

SEQ ID NO: 302 - protein, 126 aa, Arabidopsis thaliana
  misc_feature (1)..(1): Xaa is Lys or Arg
  misc_feature (5)..(5): Xaa is Ser or Cys
  misc_feature (13)..(15): Xaa can be any naturally occurring amino acid
  misc_feature (16)..(16): Xaa is Ile Val, Leu, or Met
  misc_feature (17)..(17): Xaa is Thr or Ala
  misc_feature (18)..(19): Xaa can be any naturally occurring amino acid
  misc_feature (26)..(26): Xaa is Ser or Thr
  misc_feature (27)..(27): Xaa is Ile Val, Leu, or Met
  misc_feature (30)..(30): Xaa can be any naturally occurring amino acid
  misc_feature (32)..(32): Xaa can be any naturally occurring amino acid
  misc_feature (33)..(33): Xaa can be Thr or absent
  misc_feature (34)..(34): Xaa can be Phe or absent
  misc_feature (35)..(35): Xaa can be Leu or absent
  misc_feature (36)..(36): Xaa can be Phe or absent
  misc_feature (37)..(37): Xaa can be Ile or absent
  misc_feature (38)..(38): Xaa can be Gln or absent
  misc_feature (39)..(39): Xaa can be Ile or absent
  misc_feature (40)..(40): Xaa can be His or absent
  misc_feature (41)..(42): Xaa can be Leu or absent
  misc_feature (43)..(43): Xaa can be Phe or absent
  misc_feature (44)..(44): Xaa can be Gly or absent
  misc_feature (46)..(46): Xaa can be any naturally occurring amino acid
  misc_feature (64)..(64): Xaa is Ile Val, Leu, or Met
  misc_feature (65)..(65): Xaa is Lys or Arg
  misc_feature (68)..(68): Xaa is Thr or Ala
  misc_feature (70)..(70): Xaa is Ser, Ala, or Thr
  misc_feature (71)..(72): Xaa can be any naturally occurring amino acid
  misc_feature (74)..(76): Xaa can be any naturally occurring amino acid
  misc_feature (78)..(78): Xaa is Ile Val, Leu, or Met
  misc_feature (79)..(79): Xaa can be any naturally occurring amino acid
  misc_feature (82)..(83): Xaa can be any naturally occurring amino acid
  misc_feature (84)..(84): Xaa is Ile Val, Leu, or Met
  misc_feature (87)..(87): Xaa is Lys or Arg
  misc_feature (93)..(93): Xaa is Ser, Ala, or Thr
  misc_feature (94)..(94): Xaa can be any naturally occurring amino acid
  misc_feature (103)..(103): Xaa is Ile Val, Leu, or Met
  misc_feature (106)..(106): Xaa can be any naturally occurring amino acid
  misc_feature (110)..(110): Xaa can be any naturally occurring amino acid
  misc_feature (111)..(111): Xaa is Ile Val, Leu, or Met
  misc_feature (114)..(114): Xaa is Lys or Arg
  misc_feature (115)..(115): Xaa is Ile Val, Leu, or Met
  misc_feature (116)..(117): Xaa can be any naturally occurring amino acid
  misc_feature (118)..(118): Xaa is Lys or Arg
  misc_feature (123)..(123): Xaa can be any naturally occurring amino acid
  misc_feature (126)..(126): Xaa is Lys or Gln
  AtMYB50 clade consensus sequence
XGLWXPEEDEKLXXXXXXXGHGCWSXXPKXAXXXXXXXXXXXXXLXRCGKSCRLRWINYLRPDXXRGXFXXXEXXXIXXLHXXXGNXWSQIAXXLPGRTDNEXKNXWNSXXKKXXXXXGIDPXTHX

SEQ ID NO: 303 - protein, 60 aa, Arabidopsis thaliana
  misc_feature (1)..(1): Xaa is Lys or Arg
  misc_feature (5)..(5): Xaa is Ser or Cys
  misc_feature (13)..(15): Xaa can be any naturally occurring amino acid
  misc_feature (16)..(16): Xaa is Ile Val, Leu, or Met
  misc_feature (17)..(17): Xaa is Thr or Ala
  misc_feature (18)..(19): Xaa can be any naturally occurring amino acid
  misc_feature (26)..(26): Xaa is Ser or Thr
  misc_feature (27)..(27): Xaa is Ile Val, Leu, or Met
  misc_feature (30)..(30): Xaa can be any naturally occurring amino acid
  misc_feature (32)..(32): Xaa can be any naturally occurring amino acid
  misc_feature (33)..(33): Xaa can be Thr or absent
  misc_feature (34)..(34): Xaa can be Phe or absent
  misc_feature (35)..(35): Xaa can be Leu or absent
  misc_feature (36)..(36): Xaa can be Phe or absent
  misc_feature (37)..(37): Xaa can be Ile or absent
  misc_feature (38)..(38): Xaa can be Gln or absent
  misc_feature (39)..(39): Xaa can be Ile or absent
  misc_feature (40)..(40): Xaa can be His or absent
  misc_feature (41)..(42): Xaa can be Leu or absent
  misc_feature (43)..(43): Xaa can be Phe or absent
  misc_feature (44)..(44): Xaa can be Gly or absent
  misc_feature (46)..(46): Xaa can be any naturally occurring amino acid
  AtMYB50 clade DNA binding domain consensus sequence
XGLWXPEEDEKLXXXXXXXGHGCWSXXPKXAXXXXXXXXXXXXXLXRCGKSCRLRWINYL

SEQ ID NO: 304 - protein, 46 aa, Arabidopsis thaliana
  misc_feature (3)..(3): Xaa is Thr or Ala
  misc_feature (5)..(5): Xaa is Ser, Ala, or Thr
  misc_feature (6)..(7): Xaa can be any naturally occurring amino acid
  misc_feature (9)..(11): Xaa can be any naturally occurring amino acid
  misc_feature (13)..(13): Xaa is Ile Val, Leu, or Met
  misc_feature (14)..(14): Xaa can be any naturally occurring amino acid
  misc_feature (17)..(18): Xaa can be any naturally occurring amino acid
  misc_feature (19)..(19): Xaa is Ile Val, Leu, or Met
  misc_feature (22)..(22): Xaa is Lys or Arg
  misc_feature (28)..(28): Xaa is Ser, Ala, or Thr
  misc_feature (29)..(29): Xaa can be any naturally occurring amino acid
  misc_feature (38)..(38): Xaa is Ile Val, Leu, or Met
  misc_feature (41)..(41): Xaa can be any naturally occurring amino acid
  misc_feature (45)..(45): Xaa can be any naturally occurring amino acid
  misc_feature (46)..(46): Xaa is Ile Val, Leu, or Met
  AtMYB50 clade DNA binding domain consensus sequence
RGXFXXXEXXXIXXLHXXXGNXWSQIAXXLPGRTDNEXKNXWNSXX

SEQ ID NO: 305 - protein, 9 aa, Arabidopsis thaliana
  misc_feature (1)..(1): Xaa is Lys or Arg
  misc_feature (6)..(6): Xaa can be any naturally occurring amino acid
  misc_feature (9)..(9): Xaa is Lys or Gln
  AtMYB50 clade consensus motif
XGIDPXTHX

SEQ ID NO: 306 - DNA, 861 bp, Arabidopsis thaliana
  CRF1 (AT4G11140.1 or g1421)
atggagacagagaagaaagtttctctcccaagaatcttacgaatctctgttactgatccttacgcaacagattcgtcaagcgacgaagaagaagaagttgattttgatgcattatctacaaaacgacgtcgtgttaagaagtacgtgaaggaagtggtgcttgattcggtggtttctgataaagagaagccgatgaagaagaagagaaagaagcgcgttgttactgttccagtggttgttacgacggcgacgaggaagtttcgtggagtgaggcaaagaccgtggggaaaatgggcggcggagattagagatccgagtagacgtgttagggtttggttaggtacttttgacacggcggaggaagctgccattgtttacgataacgcagctattcagctacgtggtcctaacgcagagcttaacttccctcctcctccggtgacggagaatgttgaagaagcttcgacggaggtgaaaggagtttcggattttatcattggcggtggagaatgtcttcgttcgccggtttctgttctcgaatctccgttctccggcgagtctactgcggttaaagaggagtttgtcggtgtatcgacggcggagattgtggttaaaaaggagccgtcttttaacggttcagatttctcggcgccgttgttctcggacgacgacgtttttggtttctcgacgtcgatgagtgaaagtttcggcggcgatttatttggagataatctttttgcggatatgagttttggatccgggtttggattcgggtctgggtctggattctccagctggcacgttgaggaccattttcaagatattggggatttattcgggtcggatcctgtcttaactgtt

SEQ ID NO: 307 - protein, 287 aa, Arabidopsis thaliana
  CRF1 (AT4G11140.1 or g1421) polypeptide
METEKKVSLPRILRISVTDPYATDSSSDEEEEVDFDALSTKRRRVKKYVKEVVLDSVVSDKEKPMKKKRKKRVVTVPVVVTTATRKFRGVRQRPWGKWAAEIRDPSRRVRVWLGTFDTAEEAAIVYDNAAIQLRGPNAELNFPPPPVTENVEEASTEVKGVSDFIIGGGECLRSPVSVLESPFSGESTAVKEEFVGVSTAEIVVKKEPSFNGSDFSAPLFSDDDVFGFSTSMSESFGGDLFGDNLFADMSFGSGFGFGSGSGFSSWHVEDHFQDIGDLFGSDPVLTV

SEQ ID NO: 308 - DNA, 882 bp, Arabidopsis thaliana
  AT2G46310.1
atgaaaagccgagtgagaaaatccaagtacacggttcaccggaaaatcacatccacaccgttcgacggtttcccgaagattgtcaaaatcatagtcactgacccatgcgctactgattcttccagcgatgaggaaaacgacaacaaatctgttgctccgagggtgaaacgttatgtggatgagatcaggttctgtgacgaagatgacgaacctaaaccggcgaggaaagcgaagaaaaagtccccggcggctgcggcggagaacggtggagatttggtaaagtctgtggtgaagtatagaggagtgagacaacgaccttggggaaaatttgcggcggagattcgtgatccttcgagtcgtactagactctggcttgggacttttgcgacggcggaggaagctgctataggttacgatagagccgcgattcgaatcaaaggtcataacgctcagacgaattttctcactcctcctcctagtccgacgactgaggtgttaccggaaactccggtgattgaccttgaaactgtctctggttgtgattcggcgagggaatcgcaaatcagtctgtgttctccgacttctgttctccggtttagtcacaacgacgaaacagagtacagaacagagccaacggaagaacaaaatccgtttttcttgcctgatttgtttcgctccggagattatttttgggattccgaaattacccctgaccctttgtttctcgacgaattccaccagtccttgttaccaaacatcaacaacaacaacacagtgtgtgataaggatacgaatctgtctgatagttttccgttgggagtgatcggagatttcagctcatgggatgttgatgagtttttccaagatcatttgttggataag

SEQ ID NO: 309 - protein, 294 aa, Arabidopsis thaliana
  AT2G46310.1 polypeptide
MKSRVRKSKYTVHRKITSTPFDGFPKIVKIIVTDPCATDSSSDEENDNKSVAPRVKRYVDEIRFCDEDDEPKPARKAKKKSPAAAAENGGDLVKSVVKYRGVRQRPWGKFAAEIRDPSSRTRLWLGTFATAEEAAIGYDRAAIRIKGHNAQTNFLTPPPSPTTEVLPETPVIDLETVSGCDSARESQISLCSPTSVLRFSHNDETEYRTEPTEEQNPFFLPDLFRSGDYFWDSEITPDPLFLDEFHQSLLPNINNNNTVCDKDTNLSDSFPLGVIGDFSSWDVDEFFQDHLLDK

SEQ ID NO: 310 - DNA, 945 bp, Arabidopsis thaliana
  AT3G61630.1
atggagagacgaacgagacgagtgaagttcacagagaatcgtacggtcacaaacgtagcagctacaccatctaacgggtctccgagactggtccgtatcactgttactgatcctttcgctactgactcgtctagcgacgacgacgacaacaacaacgtcacggtggttccaagagtgaaacgatacgtgaaggagattagattctgccaaggtgaatcttcttcctccaccgcggcgaggaaaggtaagcacaaggaggaggaaagcgtagtggttgaagatgacgtgtcgacgtcggtgaagcctaaaaagtacagaggcgtgagacagagaccttggggaaaattcgcggcggagattagagatccgtcgagccgtactcggatttggcttgggacttttgtcacggcggaggaagctgctatagcgtacgatagagccgcgattcatctcaaaggacctaaagcgctcacgaatttcctaactccgccgacgccaacgccggttatcgatctccaaacggtttccgcctgcgattacggtagagattctcggcagagccttcattcaccgacctctgttctaagattcaacgtcaacgaggaaacagagcatgagattgaagcgatcgagctatctccggagagaaagtcgacggttataaaagaagaagaagaatcgtcggcgggtttggtgttcccggatccgtatctgttaccggatttatctctcgccggcgaatgtttttgggataccgaaattgcccctgaccttttgtttctcgatgaagaaaccaaaatccaatcaacgttgttaccaaacacagaggtttcgaaacaaggagaaaacgaaactgaagatttcgagtttggtttgattgatgatttcgagtcttctccatgggatgtggatcatttcttcgaccatcatcatcactctttcgat

SEQ ID NO: 311 - protein, 315 aa, Arabidopsis thaliana
  AT3G61630.1 polypeptide
MERRTRRVKFTENRTVTNVAATPSNGSPRLVRITVTDPFATDSSSDDDDNNNVTVVPRVKRYVKEIRFCQGESSSSTAARKGKHKEEESVVVEDDVSTSVKPKKYRGVRQRPWGKFAAEIRDPSSRTRIWLGTFVTAEEAAIAYDRAAIHLKGPKALTNFLTPPTPTPVIDLQTVSACDYGRDSRQSLHSPTSVLRFNVNEETEHEIEAIELSPERKSTVIKEEEESSAGLVFPDPYLLPDLSLAGECFWDTEIAPDLLFLDEETKIQSTLLPNTEVSKQGENETEDFEFGLIDDFESSPWDVDHFFDHHHHSFD

SEQ ID NO: 312 - DNA, 1029 bp, Arabidopsis thaliana
  AT4G23750.1
atggaagcggagaagaaaatggttctaccgagaatcaaattcacagagcacaaaaccaacacgacaacaatcgtatcggagttaaccaacactcaccaaaccaggattcttcgtatctcagtcactgacccagacgctactgattcctccagtgacgacgaagaagaagaacatcaacgctttgtctctaaacgccgtcgtgttaagaagtttgtcaacgaagtctatctcgattccggtgctgttgttactggtagttgtggtcaaatggagtcgaagaagagacaaaagagagcggttaaatcggagtctactgtttctccggttgtttcagcgacgacgactacgacgggagagaagaagttccgaggagtgagacagcgtccatggggaaaatgggcggcggagataagagatccgttgaaacgtgtacggctctggttaggtacttacaacacggcggaagaagctgctatggtttacgataacgccgctattcagcttcgtggtcccgacgctctgactaatttctcagtcactccgacaacagcgacggagaagaaagccccaccaccgtctccggtgaagaagaagaagaagaaaaacaacaaaagcaaaaaatccgttactgcttcttcctccatcagcagaagcagcagcaacgattgtctctgctctccggtgtctgttctccgatctcctttcgccgtcgacgaattctccggcatttcttcatcaccagtcgcggccgttgtagtcaaggaagagccatccatgacaacggtatctgaaactttctctgatttctcggcgcccttgttctcagatgatgacgtgttcgatttccggagctcagtggttcccgactatctcggcggcgatttatttggggaagatctattcacggcggatatgtgtacggatatgaacttcggattcgatttcggatccggattatccagctggcacatggaggaccattttcaagatatcggggatctattcgggtcggatcctcttttagctgtt

SEQ ID NO: 313 - protein, 343 aa, Arabidopsis thaliana
  AT4G23750.1 polypeptide
MEAEKKMVLPRIKFTEHKTNTTTIVSELTNTHQTRILRISVTDPDATDSSSDDEEEEHQRFVSKRRRVKKFVNEVYLDSGAVVTGSCGQMESKKRQKRAVKSESTVSPVVSATTTTTGEKKFRGVRQRPWGKWAAEIRDPLKRVRLWLGTYNTAEEAAMVYDNAAIQLRGPDALTNFSVTPTTATEKKAPPPSPVKKKKKKNNKSKKSVTASSSISRSSSNDCLCSPVSVLRSPFAVDEFSGISSSPVAAVVVKEEPSMTTVSETFSDFSAPLFSDDDVFDFRSSVVPDYLGGDLFGEDLFTADMCTDMNFGFDFGSGLSSWHMEDHFQDIGDLFGSDPLLAV

SEQ ID NO: 314 - DNA, 1005 bp, Arabidopsis thaliana
  AT4G27950.1
atgatgatggatgagtttatggatcttagaccagtgaagtacacagagcacaagactgttatcagaaagtacactaaaaagtcgtctatggagaggaagaccagtgttcgtgactcggccaggttggttcgggtctcaatgacggatcgtgacgccactgattcatcaagcgacgaggaagagtttctgttccctcgaagacgtgtcaagagattgattaacgagatcagagtcgagcctagcagctcttccaccggcgacgtctctgcttctccgacgaaggaccggaaaagaatcaacgttgattctacggttcaaaagccctctgtttccggccaaaaccagaagaagtaccgcggcgtgagacagcgaccatggggaaaatgggcggcggagattcgtgatcctgagcaacgccggagaatctggctcggtacttttgcaacggcggaggaagctgccatcgtctacgacaacgcagcaatcaaacttcgtggccctgatgctcttaccaacttcaccgtacaaccagaaccagaaccggtacaagaacaagaacaagaaccggagagcaacatgtcggtttcgatatcagaatcaatggacgattctcaacatctatcatctccgacatcggttctcaactaccaaacatatgtctcggaggaaccaatcgatagtcttatcaaaccggttaaacaagagtttcttgaaccagaacaagagccaataagctggcatcttggagaaggtaatactaatactaatgatgattcatttccattggacattacatttctcgacaactatttcaatgaatcattaccagacatctccatcttcgatcaacctatgtctcctattcaaccaacagagaatgatttcttcaacgaccttatgttattcgatagcaacgcagaagaatactactcctccgagatcaaagagattggttcatcgttcaacgatcttgatgattctttgatatccgatctcttacttgtg

SEQ ID NO: 315 - protein, 335 aa, Arabidopsis thaliana
  AT4G27950.1 polypeptide
MMMDEFMDLRPVKYTEHKTVIRKYTKKSSMERKTSVRDSARLVRVSMTDRDATDSSSDEEEFLFPRRRVKRLINEIRVEPSSSSTGDVSASPTKDRKRINVDSTVQKPSVSGQNQKKYRGVRQRPWGKWAAEIRDPEQRRRIWLGTFATAEEAAIVYDNAAIKLRGPDALTNFTVQPEPEPVQEQEQEPESNMSVSISESMDDSQHLSSPTSVLNYQTYVSEEPIDSLIKPVKQEFLEPEQEPISWHLGEGNTNTNDDSFPLDITFLDNYFNESLPDISIFDQPMSPIQPTENDFFNDLMLFDSNAEEYYSSEIKEIGSSFNDLDDSLISDLLLV

SEQ ID NO: 316 - DNA, 1062 bp, Arabidopsis thaliana
  AT5G53290.1
atggacgaatatattgatttccgaccattgaagtacacagagcacaagacttcaatgactaaatacaccaaaaagtcatcggaaaaactttccggtggtaagtcattgaaaaaggttagtatttgttatactgatcctgacgcaacagattcatcaagtgacgaagacgaagaagatttcttgtttcctcgccggagagtcaaaagattcgttaacgagatcactgttgagcctagctgtaacaacgtcgtcaccggagtttcgatgaaagatagaaagagactctcttcttcctccgatgaaactcaatctccggcgtcgagtcgtcaacgtcctaataacaaagtttcagtctccggtcagataaagaagttccgtggtgttagacaacggccatgggggaaatgggcggcggagattagagatccggagcaacgtcggaggatttggctcgggacttttgagacggcggaggaagctgccgtggtttatgataacgccgctataagactccgtggaccggacgctttaactaatttctccataccgcctcaagaagaggaagaagaagaagaaccggaaccggttattgaggagaaaccggttattatgacgacgccaacaccaacaacatcgagttctgaatcaactgaagaagatttacaacatctctcatctcctacttcggttctcaatcaccggtcagaagagattcaacaagtacaacaaccgtttaaatcagctaaacccgaaccgggggtttcaaatgcaccatggtggcataccgggtttaataccggtttaggtgaatcagacgattcatttcctttggatactccgtttcttgacaactatttcaatgaatcaccaccagagatgtcaatatttgaccaaccaatggatcaaattttctgtgaaaatgatgatatcttcaatgatatgttgttcttgggtggtgaaactatgaacattgaagatgagttaacaagttctagtatcaaagatatgggttcaacgtttagtgattttgatgattcattgatatcagatctattagttgct

SEQ ID NO: 317 - protein, 354 aa, Arabidopsis thaliana
  AT5G53290.1 polypeptide
MDEYIDFRPLKYTEHKTSMTKYTKKSSEKLSGGKSLKKVSICYTDPDATDSSSDEDEEDFLFPRRRVKRFVNEITVEPSCNNVVTGVSMKDRKRLSSSSDETQSPASSRQRPNNKVSVSGQIKKFRGVRQRPWGKWAAEIRDPEQRRRIWLGTFETAEEAAVVYDNAAIRLRGPDALTNFSIPPQEEEEEEEPEPVIEEKPVIMTTPTPTTSSSESTEEDLQHLSSPTSVLNHRSEEIQQVQQPFKSAKPEPGVSNAPWWHTGFNTGLGESDDSFPLDTPFLDNYFNESPPEMSIFDQPMDQIFCENDDIFNDMLFLGGETMNIEDELTSSSIKDMGSTFSDFDDSLISDLLVA

SEQ ID NO: 318 - DNA, 1188 bp, Solanum lycopersicum
  Solyc03g007460.1.1
atggattatcattcgctgtgtccgatcaaatacactgagcatcggaatgttattagaaaagttactaaaccatctttggtgaaatcaaaaaaactctcagaagctgcaaaatcctctcagttgaatccctctgttccaaggactgttcggatttctgtgacagacccagacgcaaccgattcttcaagcgatgaagaagacctgctttttggacggcgacgggtgaaaaagtacatcaatgaaatcagtattgaaactgccgtcaagtgtgaagttagcagtggaaatggcaaaacggtgaataaaagagcaccagagcctcttcagactaagcagaagccaatgaaagttcagcctcctccatcggctggtgctgctaggaagttccgcggtgtgcgtcaacggccgtggggtaaatgggcggctgagatcagggacccagctcgccgtgttcggctttggttgggaacttacgatactgctgaagaagctgctatggtttatgacaacgctgctattaagctccgtggtcccgatgctttaacaaacttcagcactcctgccaaggccgagccagaaccagaaccagagccagagcccgaaatcagtgctctgtctcactccggctatgaatccgggaatgagtcccgtaacatcccctctccaacttctgttttacggtgtacaatgagccaatcagaaagcgggtccggccaggttcatgtttcggaagagtgtccttcggttcaaggatcgatggaatgtgagcaaacggttcaaccgtttgttcaatgtgctgctgaaccgctgattccatcagcgattccgcaggacgttgaggaatgtcagggcgagaccagcatgattcctgattactcaagcgattacttgccaacagatattccattcttaaatgattttttcaatttcgatggttcagcagctgagcaaacgttacttgaggactcaactatgacagccgtaacatcaacaacaacaacaacaacaccaaacgaatttggcgatttgtgcaacgattcattggattttgggaatgatttcttgtttaacgatgctgatttcgctgaattcggcagttttgatgatctgggtgatttaggaatggatgatttttctcaagacaacagtgttgttgattattccagtgttgattctctgttagcaatt

SEQ ID NO: 319 - protein, 396 aa, Solanum lycopersicum
  Solyc03g007460.1.1 polypeptide
MDYHSLCPIKYTEHRNVIRKVTKPSLVKSKKLSEAAKSSQLNPSVPRTVRISVTDPDATDSSSDEEDLLFGRRRVKKYINEISIETAVKCEVSSGNGKTVNKRAPEPLQTKQKPMKVQPPPSAGAARKFRGVRQRPWGKWAAEIRDPARRVRLWLGTYDTAEEAAMVYDNAAIKLRGPDALTNFSTPAKAEPEPEPEPEPEISALSHSGYESGNESRNIPSPTSVLRCTMSQSESGSGQVHVSEECPSVQGSMECEQTVQPFVQCAAEPLIPSAIPQDVEECQGETSMIPDYSSDYLPTDIPFLNDFFNFDGSAAEQTLLEDSTMTAVTSTTTTTTPNEFGDLCNDSLDFGNDFLFNDADFAEFGSFDDLGDLGMDDFSQDNSVVDYSSVDSLLAI

SEQ ID NO: 320 - DNA, 1050 bp, Solanum lycopersicum
  Solyc06g051840.1.1
atggatcatcacagttcgctttgtccgatcaaatataccgaacacaagagaacaatcagaaaagttactaagccttccgttattaagcctaagaaggtatcagatgttcggaaatcctcggagtataatccgaggactgtacggatatgtgttactgatccagatgcaactgactcttcaagtgatgaagatgagctttttgggcgtaagcgtgtgaaaagatacattagtgaaatcagtattgagagtccatcagttaatgatgtgaaaactttgagtagtggtaatgggaagaagcgagtagctgaaggttcgcaggcgaagcagaaggcgttgaaagggaaggaagtggctgataaaacggttcggaagttcaggggagtgcgtcaacggccgtggggtaaatgggctgctgaaatcagagacccagcgcgtcgcgttaggctctggttaggtacttatgatactgctgaagaagctgctatggtttatgataatgcagctattaagctccgtggaccagatgctttaactaatttcatcactcctccaataaaagagaagccggaagtgaatgtggcttcgaattcggggtacgaatctggtgatgaatcacacaatctttcttctcctacctctgttttgcggttcagaagtagcgaatccagtgaagaagcagaacccggtctcgaagacataaaagaaaattgcacagtattggtggaagaagaaccaaacagtgagcaccttgagtgccaaggcgagacacttacagtcataccagactattcaaatgactacttacccacagacgtttccttcttagacgattatttcaactttgcagatgcagaacagtcactgtttaatgacacaacaagtttcaccaatgatgatttgttttcgtcttgggatttcacaaatgactctgtgttagacccagagatctgcaaatttgatgattcatttctagacttgggtgcattagaagtggataattatttcaaagacattggagatttttccagtgttgatgtactaatggcgtta

SEQ ID NO: 321 - protein, 350 aa, Solanum lycopersicum
  Solyc06g051840.1.1 polypeptide
MDHHSSLCPIKYTEHKRTIRKVTKPSVIKPKKVSDVRKSSEYNPRTVRICVTDPDATDSSSDEDELFGRKRVKRYISEISIESPSVNDVKTLSSGNGKKRVAEGSQAKQKALKGKEVADKTVRKFRGVRQRPWGKWAAEIRDPARRVRLWLGTYDTAEEAAMVYDNAAIKLRGPDALTNFITPPIKEKPEVNVASNSGYESGDESHNLSSPTSVLRFRSSESSEEAEPGLEDIKENCTVLVEEEPNSEHLECQGETLTVIPDYSNDYLPTDVSFLDDYFNFADAEQSLFNDTTSFTNDDLFSSWDFTNDSVLDPEICKFDDSFLDLGALEVDNYFKDIGDFSSVDVLMAL

SEQ ID NO: 322 - DNA, 972 bp, Glycine max
  Glyma04g41740.1
atggaagacagtatcctatgcaaacacacagtgcatcgcagcgtcaccaagaaactcatctcccccaaaaaatcatcccaaaccaattcttcaacacaaacagagcgcagaatagtgcggatttcatacactgatccagacgccaccgactcctccagcgacgaggaaggtttccccttggttcgcaaaagaatgaagcgctatgttaaccagattgaaatagaaaccgccgcggaaaaagttgttcggaagaggcccgccggtgagccttgcaggcgaccggcgaagcttcactccgggaagaagttccgcggcgtccggcagcggccgtgggggaaatgggcggcggagattcgagatccggcgagaagagtgcgtctctggctgggaacctacgacactgccgaagaagctgccatggtctacgacaatgccgctattcggcttcgaggccctgacgcgttgacaaacttcctaacgccaccgcaaagagagtctccgtctcaggcgacaacggtggcggtgaccgaagaagcctccggctccggctacgactccggcgacgaccattgccagcacaacctctcatctcccacttcggtgctccacttccgaagcaactcggagtctgatcagaaatcagaacaagtgttgagagagtgtgagggtgagggtgagtttttggcgctggataacatgcctctgcctgcttgggatgaagtgttcaatttcgaaacgccagagtaccctccccttctctttcaagaagggaattttcttcatgattatcagtcccagatgttgggtgaaacggtaccgttttcctcggaccaagggttcagtgacagtagtatcgtgctcgcagactcgctcatagatttcgacaaagcttgccctccaccatctaccttgtgccaggtggacgatttcttccaagacattttgttagcttctgatcctctcgttctgctc

SEQ ID NO: 323 - protein, 324 aa, Glycine max
  Glyma04g41740.1 polypeptide
MEDSILCKHTVHRSVTKKLISPKKSSQTNSSTQTERRIVRISYTDPDATDSSSDEEGFPLVRKRMKRYVNQIEIETAAEKVVRKRPAGEPCRRPAKLHSGKKFRGVRQRPWGKWAAEIRDPARRVRLWLGTYDTAEEAAMVYDNAAIRLRGPDALTNFLTPPQRESPSQATTVAVTEEASGSGYDSGDDHCQHNLSSPTSVLHFRSNSESDQKSEQVLRECEGEGEFLALDNMPLPAWDEVFNFETPEYPPLLFQEGNFLHDYQSQMLGETVPFSSDQGFSDSSIVLADSLIDFDKACPPPSTLCQVDDFFQDILLASDPLVLL

SEQ ID NO: 324 - DNA, 897 bp, Glycine max
  Glyma06g13040.1
atggaagacagtatcctatgcaaacacacagtgcatcacaccgttaccaagaaactcatctcccccaaaaaatcatcccaaaccaattcgacgacagagcgcagaatagtgcggatttcatacactgatccagacgcaaccgactcctccagcgacgaggaaggtttccccttcgttcgccaaagaatgaagcgctatgttaaccagattgaaatagaaaccgccgccgccgaaaaagttgttcggaaaaggcccgccggtgaggcttgccgccggccggcgaagcttcactccgggaagaagttccgcggcgtccggcagcgaccgtgggggaaatgggcggcggagattcgggatccggcgagaagagtgcgtctctggttgggaacctacgacaccgccgaagaagctgctatggtttacgacaatgccgctattcgtcttcgtggccctgacgcgttaacaaacttcgtaacgccgccgaaaagagattctccgtctccgtctccaccgccggcggcggcggagactccggcggaggtttgcgagatgaaggttgtggtcaccgaagaagcctccggctccggctacgactccagcgaggatcattgccaccacaacctctcctctccgacttcggttctccagttccgaagcaactcgagcgaagaaaattccgagtctcagcagaaagcagaacaagtgttgagagaatgcgagggtgagacagaaacgagtttgttcgaggaaacgggtgagtttttggcgctggataacatgcctttgcctgcctgggatgacgtgttcaatttcgaaacgccagaagcctgcccttcaccatcctccttgtgccaagtggacgatttcttccaagacattttgtttgcttctgatcct

SEQ ID NO: 325 - protein, 300 aa, Glycine max
  Glyma06g13040.1 polypeptide
MEDSILCKHTVHHTVTKKLISPKKSSQTNSTTERRIVRISYTDPDATDSSSDEEGFPFVRQRMKRYVNQIEIETAAAEKVVRKRPAGEACRRPAKLHSGKKFRGVRQRPWGKWAAEIRDPARRVRLWLGTYDTAEEAAMVYDNAAIRLRGPDALTNFVTPPKRDSPSPSPPPAAAETPAEVCEMKVVVTEEASGSGYDSSEDHCHHNLSSPTSVLQFRSNSSEENSESQQKAEQVLRECEGETETSLFEETGEFLALDNMPLPAWDDVFNFETPEACPSPSSLCQVDDFFQDILFASDPL

SEQ ID NO: 326 - DNA, 1005 bp, Glycine max
  Glyma13g08490.1
atggaaccacaaaaccgcagcaatagcatcctatgcaaatacactgaacacgaaaccgttacaaaaaaacacatgaaatcaaaaaacaatacttctctttcgcctaaagtcatttccatattgatgacggatcaatatgctacagactcatccagcgacgaagaaagagtcacgagccgccggcgcatcaagcgttatgtcaatagaatcgagcttcagccggcgattaaatccgtcgctaccagaaagagacacgttggagacgccacgaaactacggccgccgcaggtgaaggtgaagaattctggcagcgtgaaaaaattccgcggtgtgaggcaacgcccatggggtaaatgggcggcggagatacgggatcctgtgcagcgcgtgagaatctggctgggaaccttcgaaaccgcggaggaggccgccttgtgttacgacaatgccgcaatcatgctccgcggcccggacgccctaacgaatttcgggatacggtcaaaggaaacgttggagaaagaagaaagaaaagagttggatgaaaaggaagaaatcagaaccgaaaaaccggaaatgaaggtggtcgtgaaaccggagattgaaactgctttggtctcctgcttctacgactcggcggacgagttttgtctgaacctctcgtcacccacttcagttctccggttcaacgaatcagctgaactggagaaacagtacgagccgtttcccggtcgaaccgaagcccacaccgtgctggaagagtgtcaaggacaaactgtgtcgtttcatgaaagtagtgagtttatgttacaagacatgccgtgggatgatgtgtttaattttccggtaatgttcgacgagccggtgtcgcacttgtttgacgaaacgacgcggttttcgagtagtgaggttttcagtgaggaaaagtttttgccgtcagcaacgttgtgccaagtggacgattatttccaagacattttgttagggtcagatcctctggtggctctg

SEQ ID NO: 327 - protein, 335 aa, Glycine max
  Glyma13g08490.1 polypeptide
MEPQNRSNSILCKYTEHETVTKKHMKSKNNTSLSPKVISILMTDQYATDSSSDEERVTSRRRIKRYVNRIELQPAIKSVATRKRHVGDATKLRPPQVKVKNSGSVKKFRGVRQRPWGKWAAEIRDPVQRVRIWLGTFETAEEAALCYDNAAIMLRGPDALTNFGIRSKETLEKEERKELDEKEEIRTEKPEMKVVVKPEIETALVSCFYDSADEFCLNLSSPTSVLRFNESAELEKQYEPFPGRTEAHTVLEECQGQTVSFHESSEFMLQDMPWDDVFNFPVMFDEPVSHLFDETTRFSSSEVFSEEKFLPSATLCQVDDYFQDILLGSDPLVAL

SEQ ID NO: 328 - DNA, 963 bp, Glycine max
  Glyma14g29040.1
atggaacaacaaaacagcatcctatgcaaatacactgaacaccagaccgtcatgaaaaaacacatgaaatccaaagataacactttctgttcacctaaagtcatctccatatccttaatcgatccatacgccacagactcatccagcgacgaagagaatgttatgcgccggaggcgcgtgaagcgctacgtcaacagaatcgaacttcagccggcgttcaaacccgtcactacaagaaagagacacgccggagacgccgccactctccggaagccaccggcgaaggtgacaaattcctgcaggaaattccgcggcgtgaggcagcggccgtggggtaaatgggcggctgaaataagggatcccgtgcagcgagtgagaatctggctcggaaccttcaaaaccgccgaggaggccgccttgtgctatgacaatgcggcgatcacgctccgcggccccgacgcgctaacgaacttcgggaggtcgcggccggaggaaacgccggaaaaagaagagatgccggaaatgaaagtcgtcgtgaaaccagagacccaagtttcagtttcggtctccggctgctacgactcgggcgacgagtgttgtctcaacctatcgtcgcccacttcggttctccagttcagtgctgaaccgtataaaccggacgagccgtttcccgacatgccgtgggatgatgtgtttaattttccggttatgtttgacgagccgctgtcgcacttgtttgatgaaacgacgccgttttcgattagtgacgtggacgattatttccaagacatcttgttagggtcagatcctctcgtgctcttttgttttggtttgattctcgttgctttggttttggcatttttgggtgactattcaagttttttggcccggacaacacaatgtgtgaacaataaatctagtgtatgtgaaatgaagtgccgccgactcttcccttgcaggcgg

SEQ ID NO: 329 - protein, 321 aa, Glycine max
  Glyma14g29040.1 polypeptide
MEQQNSILCKYTEHQTVMKKHMKSKDNTFCSPKVISISLIDPYATDSSSDEENVMRRRRVKRYVNRIELQPAFKPVTTRKRHAGDAATLRKPPAKVTNSCRKFRGVRQRPWGKWAAEIRDPVQRVRIWLGTFKTAEEAALCYDNAAITLRGPDALTNFGRSRPEETPEKEEMPEMKVVVKPETQVSVSVSGCYDSGDECCLNLSSPTSVLQFSAEPYKPDEPFPDMPWDDVFNFPVMFDEPLSHLFDETTPFSISDVDDYFQDILLGSDPLVLFCFGLILVALVLAFLGDYSSFLARTTQCVNNKSSVCEMKCRRLFPCRR

SEQ ID NO: 330 - DNA, 1002 bp, Glycine max
  Glyma05g37120.1
atggcttcatcttccataaaaaacacacaccaccttaaccgcacaaaactcttcatggaagaagatacccttttgaagaagaagcgtcactaccccaaactcatacgaatacgtgtcaccgacgccgacgctactgactcttccagcgacgacgacgagccctcggtgtcctccacgcgccgccgagtcaaatacttcgtcaacgagattaccatccaaggcggcggcggcggtggtggttgcgttaacgttgtttctaggaaaagaaggttcaaggctggtgccggagctccatcgtgtcggcggcggacgggggcgaagaagttccggggagtgaggcagcggccgtgggggaagtgggcggcggagattagggacccgttgcgccgcgtgcggctgtggctgggaacctacgacaccgccgaggaagccgccattgtgtacgacaacgcggccattcagcttcgcggtgccgacgcgctcaccaatttcgtaacgccgccgcgggagaacagaaaaaccggttactgctccggcgaggagtcacggaacaacgacttgcgttcccccacttcggttcttgggtgccgttcggtgtacgaggaagctgagtccgtaaccgcaaacgcaaccggaaacgacgtcgtcgacgagtccgtaacagtagtcgcaaacgacgtcgttgggccctcaagtgagtgcgagtattcatgcgtttcggaagatagtaataatgataagttgaaaccggagtcagtgtttcctattccaaacgatgtggtgtttgactttcaaagcacgttagatatgtttgatgaagggattaatactaataataataataatgtggcagagagtagtatattcttggcggaggattttgatttcaaaggaagctttgttaatgagaatttagatttgggttttacgagttggcatagagagtgtgataatttccaagacattggggatttgtttgtttgggatcctcttgtcgctctt

SEQ ID NO: 331 - protein, 334 aa, Glycine max
  Glyma05g37120.1 polypeptide
MASSSIKNTHHLNRTKLFMEEDTLLKKKRHYPKLIRIRVTDADATDSSSDDDEPSVSSTRRRVKYFVNEITIQGGGGGGGCVNVVSRKRRFKAGAGAPSCRRRTGAKKFRGVRQRPWGKWAAEIRDPLRRVRLWLGTYDTAEEAAIVYDNAAIQLRGADALTNFVTPPRENRKTGYCSGEESRNNDLRSPTSVLGCRSVYEEAESVTANATGNDVVDESVTVVANDVVGPSSECEYSCVSEDSNNDKLKPESVFPIPNDVVFDFQSTLDMFDEGINTNNNNNVAESSIFLAEDFDFKGSFVNENLDLGFTSWHRECDNFQDIGDLFVWDPLVAL

SEQ ID NO: 332 - DNA, 879 bp, Glycine max
  Glyma08g02460.1
atggcttcatcttccatcaaacacactcaccaccttaaccgcacaaaactcttcatgaaagaagaaacccttttgaaaaagaagcatcactatcccaaaatcatacgaatacgtgtcaccgacgccgacgctaccgactcctccagcgacgacgacgagccctccatgtcctccacgcgccgcagagtaaaaaacttcgtcaacgaaattaccatccaaggcggcggcggtggtggtggcgacgttaacgttgtttctaagaaaagaagattcaagtccggtgccggagctccgttatgtcggcggaagacgggggcgaagaagttccggggagtgaggcagcggccatgggggaagtgggcggcggagataagagacccgtcgcgccgcgtccggctgtggctgggaacctacgacaccgccgaggaagctgccattgtgtacgacaacgcggccattcagctgcgtggcgccgacgcgctcaccaatttcataacgccgccgccggagaacagaaaaaccggttactgctccggcgaggagtctcgcaacaacgacgacttgcgttcccccacttcggttcttgggcgctgttcggtgtccgaggaagctgtaactgcaaacgacgtatttggaggctctagtgagtgcgagtattcatgcgtttcggagtcagtgtttcctattcctaacgaggtggtgtttgactttgaaagcacgttagatatgtttgatgaagggattaataatgttgtggcagagactagtatattcttggcggaggatttagatttgggttttacgagttggcatagagagtgtgataatttccaagacattgggggggatttgtttgtttgggatcctcttgtcgctctt

SEQ ID NO: 333 - protein, 293 aa, Glycine max
  Glyma08g02460.1 polypeptide
MASSSIKHTHHLNRTKLFMKEETLLKKKHHYPKIIRIRVTDADATDSSSDDDEPSMSSTRRRVKNFVNEITIQGGGGGGGDVNVVSKKRRFKSGAGAPLCRRKTGAKKFRGVRQRPWGKWAAEIRDPSRRVRLWLGTYDTAEEAAIVYDNAAIQLRGADALTNFITPPPENRKTGYCSGEESRNNDDLRSPTSVLGRCSVSEEAVTANDVFGGSSECEYSCVSESVFPIPNEVVFDFESTLDMFDEGINNVVAETSIFLAEDLDLGFTSWHRECDNFQDIGGDLFVWDPLVAL

SEQ ID NO: 334 - DNA, 756 bp, Glycine max
  Glyma01g43350.1
atgactgcgccaccatccaagtacactcaccactccaaactactcattccctccgaagaagaccctcccaaacacccctatcccagactcgtcagaataaccgtcacagacaccgaggccacagactcctccagcgacgaagaacagcatacttccacgcgccaccgacacagaaagttcgtcaacgagatttctatcgagtcgtcgtgcgccagcgagaacgacggcgccgcttcgaggaagagaattcgaagaagaagcaccgctacgcccaaaggcagagcttcagacactcggctcgtgtccaacggcaagaaattccgcggagtgagacagcggccttggggaaaatgggcggcggagatacgagacccgtctcgacgcgttcgtttatggttgggtacctacgacactgctgaggaagctgctttggtgtacgacaacgcggccattaggctgcgtggaccccacgcgctcaccaatttcataacaccgcctgccacgtgtcacaacacagaccctccgccggaagctgagtccgtaaggggaaaagacgatgagggaaaagacgatgagtactcctccgtgtcgatgagtagggtcaaggctgagtcaccatttccgagtgtgttgttctacgatgatgattggtctagtgagtttctcactgcttgtgaggattttggtttcaacagaaatcgtgactttttccaagatatcgacgatttgtttgtttcggatcccctccttgctctc

SEQ ID NO: 335 - protein, 252 aa, Glycine max
  Glyma01g43350.1 polypeptide
MTAPPSKYTHHSKLLIPSEEDPPKHPYPRLVRITVTDTEATDSSSDEEQHTSTRHRHRKFVNEISIESSCASENDGAASRKRIRRRSTATPKGRASDTRLVSNGKKFRGVRQRPWGKWAAEIRDPSRRVRLWLGTYDTAEEAALVYDNAAIRLRGPHALTNFITPPATCHNTDPPPEAESVRGKDDEGKDDEYSSVSMSRVKAESPFPSVLFYDDDWSSEFLTACEDFGFNRNRDFFQDIDDLFVSDPLLAL

SEQ ID NO: 336 - DNA, 1017 bp, Solanum lycopersicum
  Solyc08g081960.1.1
atggaccaacaaaccatgttgtctagtggtgttaagtataccgaacatagaaagcaaatcactatggttagaccagcacctccggtgacttttaatggtcggaggagaagctctgagatgaatgctgccggtcctagagttgtaaggattactgttactgatgctgatgctactgactcttcgagtgatgaaggggaacaggggttttatggccgtcaaagagtgagaaagtttgtgaatgaagttcggatagagcagagcagccactgtaatggaagtgtaaatggggttttgagaaatgggtcatcgtcggaaactgctcccgttgtcgctgcagcaccgaagaggaggaagaagaccgccggagcaacaacggcggcgagtaagctaaaagtgaaccatgttaaaaagtttcgcggcgtacggcaacggccttggggcaaatgggcggcagaaatcagagatccactgagacgtgtacggttatggttaggcacttacgatactgctgaagaagctgccatggtttatgaccacgcggctattcagctacgtgggcctgacgcgctcacaaacttcgccactcctccggcgacgaaaatcagctgctccagctacaactccggcgaagaatcgcacaacgatcaacgctcgccgaagtccgttctacgatgtgcttcaacttcatttgatgaatctcagaataacgaggaagccgaagctgagtcattaccgattttaccctccgatatcagggacaaaaatgacatttccatgtcggaaaacttctgcgatttaccaccgttcgagagtttcttccccgatgatttgtttcagttcgagaacccgattaccatatccgacttgttttttgaaccggatactttacccgactacaataatatgttattcgggtcaagtactacagattacggtttcggatcttcatcctggcccgaagaggacttctttcaggatttcggagatgtattcgggtctgacccgcttgtggctctt

SEQ ID NO: 337 - protein, 339 aa, Solanum lycopersicum
  Solyc08g081960.1.1 polypeptide
MDQQTMLSSGVKYTEHRKQITMVRPAPPVTFNGRRRSSEMNAAGPRVVRITVTDADATDSSSDEGEQGFYGRQRVRKFVNEVRIEQSSHCNGSVNGVLRNGSSSETAPVVAAAPKRRKKTAGATTAASKLKVNHVKKFRGVRQRPWGKWAAEIRDPLRRVRLWLGTYDTAEEAAMVYDHAAIQLRGPDALTNFATPPATKISCSSYNSGEESHNDQRSPKSVLRCASTSFDESQNNEEAEAESLPILPSDIRDKNDISMSENFCDLPPFESFFPDDLFQFENPITISDLFFEPDTLPDYNNMLFGSSTTDYGFGSSSWPEEDFFQDFGDVFGSDPLVAL

SEQ ID NO: 338 - DNA, 1140 bp, Oryza sativa
  LOC_Os01g12440.1
atgatgatgtggcctttggagatggaggaggggtttgtggctctcaagaggacggagcatgtcgaggtgacgtccttggcggtggcggtcgaggcgacgccgtcggcgaaggggggaaaggggaaggttgtggtgggtggtggtggcgccggcggcggcgttgggccgacgagggtgagggtgttctgtgatgacttcgacgcgacggactcgtcgagcgatgaggatgaggaggaggtgaccgcgcggcggagggtgaagcgctacgtgcaggagattcggttacagcgcgcggcggcggtggccgtgccgccggtgaaggtgaagggcgaggaggtgttcccggccgcggtgtcggcgaagatggcggaggccgcgaaggcgagggtggtgttggcggctgggaggaagaggaaggccggcggggtggacggcgccgagccgcggttccgcggcgtgcggaggcggccgtgggggaagtacgcggcggagatccgcgacccgtggaggcgggtgcgggtgtggctcggcacgttcgacaccgccgaggaggccgccaaggtgtacgacacggcggccatccagctacgcggccgcgacgccaccaccaacttcaaccagtccggggactcggcaagcctcgacgtcccacccgaggtcgccgagcgcgtcccgcagccgccgggggcgtccaagaacgcctccccggccacctcctacgactccggcgaggaatcccacgccgcggcggcctccccaacctccgtcctccgttccttccctccctccgccgtcgtcgcgaccgccgacacggccaacaagaagcagccgccgccgccgcctctcgtcgtccgcgagaccgacgagtcggtcgacgtcttcggctgctccttctccgacgacggcggcttcgccggcgagctcccacctctctacaccgacttcgacctcctcgccgacttcccggagcccccgctggacttcttgtccaacctccccgtggagcccttctccctggctcccttctccagcaacaatgggtcaccggacctccacctcgacgacgccccatcgccggcggcggcacaagtggacgacttcttccaagacatcaccgacctgttccagatccccgtcgtc

SEQ ID NO: 339 - protein, 380 aa, Oryza sativa
  LOC_Os01g12440.1 polypeptide
MMMWPLEMEEGFVALKRTEHVEVTSLAVAVEATPSAKGGKGKVVVGGGGAGGGVGPTRVRVFCDDFDATDSSSDEDEEEVTARRRVKRYVQEIRLQRAAAVAVPPVKVKGEEVFPAAVSAKMAEAAKARVVLAAGRKRKAGGVDGAEPRFRGVRRRPWGKYAAEIRDPWRRVRVWLGTFDTAEEAAKVYDTAAIQLRGRDATTNFNQSGDSASLDVPPEVAERVPQPPGASKNASPATSYDSGEESHAAAASPTSVLRSFPPSAVVATADTANKKQPPPPPLVVRETDESVDVFGCSFSDDGGFAGELPPLYTDFDLLADFPEPPLDFLSNLPVEPFSLAPFSSNNGSPDLHLDDAPSPAAAQVDDFFQDITDLFQIPVV

SEQ ID NO: 340 - DNA, 975 bp, Zea mays
  GRMZM2G044077_T01
atgtggcccatggaggaagaggaggtgttcgtgacggtgaggcggacggagcacgtcgacgtcacctcccgggcggtggtcgtggctgcggggcgcgccgccgtcgcggggcccaggacggtgcgggtcttctgcgacgactacgacgcgaccgactcgtccggcgacgaagcggaggaggaggaggaaaagaaggccgcgcgcaggagggtgaagcgctacgtgcaggagatccacctggagcgggcggcaaaggaggaggaggaggcgacggccgcggcgtctctgggggcggtgctcccggggccgaagcggaagcggaagcccgacggtgaggcctcggagccccggttccgcggcgtgcggcggcggccgtggggcaagtacgcggcggagatccgcgacccgtggcgccgggtgcgggtgtggctcggcaccttcgacaccgccgaggaggccgccaaggtgtacgactcggccgccgtccagctccgcggccgcgacgccaccaccaacttccagcagcaggtggaccccgagcgcctctcacagccggcggcgtccaagagcgccgcgacatcgacatacgactccggcgaggagtccgtgacggcggtggcgtcgccgacctccgtgctccgctcgttcccgccctccgccgacgccggcggcacacgcagcaaggctgccgcgaggaacccggagaccggcgattcgaccatcgtgttcggctgccccttctccttggccagcgagctcccggcgctgtacaccgagttcgacctgctggccgacctcccgctggacttcctcgccgacgccccggaggtggaggcgctgtccctgccgccgttctccgcctgcacacccgaggaggaggaggagtgcccgtccgacgcggtgaggtggcggcaggtggacgaattattccaagacatcaccgacctgttccagatcgacccgctgcccgtcgcc

SEQ ID NO: 341 - protein, 325 aa, Zea mays
  GRMZM2G044077_T01 polypeptide
MWPMEEEEVFVTVRRTEHVDVTSRAVVVAAGRAAVAGPRTVRVFCDDYDATDSSGDEAEEEEEKKAARRRVKRYVQEIHLERAAKEEEEATAAASLGAVLPGPKRKRKPDGEASEPRFRGVRRRPWGKYAAEIRDPWRRVRVWLGTFDTAEEAAKVYDSAAVQLRGRDATTNFQQQVDPERLSQPAASKSAATSTYDSGEESVTAVASPTSVLRSFPPSADAGGTRSKAAARNPETGDSTIVFGCPFSLASELPALYTEFDLLADLPLDFLADAPEVEALSLPPFSACTPEEEEECPSDAVRWRQVDELFQDITDLFQIDPLPVA

SEQ ID NO: 342 - DNA, 1062 bp, Zea mays
  GRMZM2G142179_T01
atgtggcccatggaggaggagatgttcctggcggtgaagcggacggagcacgtcgaggtcacttcccgggcgatggattccgcgccggcggcggggcccaggacggtgcgggtcttctgcgacgacaacgacgcgaccgactcgtccggcgacgaggcggagggcgcggccgcgcgcaggagggtgaagcgctacgtgcaggagatccggctgcagcgggcggtgccggtgaaggaggaggcggcgtccgcgagggccgtcgcgggggagcggcccaggccgctggccctcccggggcggaagaggaagtccgacggcgccggcgccggcgccgagccccggttccgcggcgtgcggcggcggccgtggggcaagtacgcggcggagatccgcgacccctggcgccgggtgcgcgtctggctcggcaccttcgacaccgccgaggaggccgccaaggtgtacgactcggccgccatccagctccgcggggccgacgccaccaccaacttcgagcacgcggcggtccccgtccccgtccccgacgaggtcgcgggtcgcctcccgcagccgccgccggctccggcgtccaagaacgcgtcgtcctccgccacgtcctcctacgactccggcgaggagtcccacgccgcggcggcctcgccgacctccgttctccgcacgttccctccgtcctccgcggccgccgacgccacctgcaagaaaccggcgccggccgcggagaccgacgagtcgaccggcgtcggcggcagcaggagcagcgtgtacgcataccccttcttcgccaacgacgactgcttcggcggcgacttccccccgctgtacactgacttcgacctgctggccgacttcccggagccgacgctggacttcctggcggacatccccgaggagaagctgccgccgctgccggagccgttccccgcggcgagccccgacgagtgcccgtccgacgcggaggcggcgtcgccggcgaggtggcagcaggtggacgacttcttccaggacatcaccgacctgttccagatcgacccgctgcccgtcgtc

SEQ ID NO: 343 - protein, 354 aa, Zea mays
  GRMZM2G142179_T01 polypeptide
MWPMEEEMFLAVKRTEHVEVTSRAMDSAPAAGPRTVRVFCDDNDATDSSGDEAEGAAARRRVKRYVQEIRLQRAVPVKEEAASARAVAGERPRPLALPGRKRKSDGAGAGAEPRFRGVRRRPWGKYAAEIRDPWRRVRVWLGTFDTAEEAAKVYDSAAIQLRGADATTNFEHAAVPVPVPDEVAGRLPQPPPAPASKNASSSATSSYDSGEESHAAAASPTSVLRTFPPSSAAADATCKKPAPAAETDESTGVGGSRSSVYAYPFFANDDCFGGDFPPLYTDFDLLADFPEPTLDFLADIPEEKLPPLPEPFPAASPDECPSDAEAASPARWQQVDDFFQDITDLFQIDPLPVV

SEQ ID NO: 344 - DNA, 966 bp, Setaria italica
  Si002247m
atgtgggccatggaggaggagatgttcgtggcggtgaggcgcacggagcacgtcgaggtcacctcccgggcggtggaggtggcgccggcggccgccgcggggccgaggaccgtcagggtgttctgcgacgactacgacgccaccgactcgtccggcgacgaggacgacgaggaggccgccgtcgccgcgcgccggagggtcaagcgctacgtgcaggagatccgcctggagcgggcggtgaaggaggcgccggccgcgaaggccgcggcgtcctccgcggccgccgcggcgaggacgaagctggtgctccccgggcggaagaggaaggccgacggcgccgagccgcggttccgcggcgtgcggcgccggccctggggcaagtacgcggcggagatccgcgacccgtggcggcgggtgcgggtgtggctgggcaccttcgacaccgccgaggaggccgccaaggtgtacgactcggcggccatccagctgcgcgggcccgacgccaccaccaacttcgagcaggtcgacgaccccgtccccactgaggtcgccgagcgcctcccgcagccgccgccggcggcggcgtccaagaacgcgtcgtcctccgccacctcctacgactccggcgaggagtcccacgcggccgcggcgtccccgacctccgttctccgctcattcccgccgtccgcggtggccgaggacacctgcggcaagaagccggcgccggcggcgcagcccgcctaccgcgccccggagaccgacgagtccagcgtcgacggcagcgtgttcggctgccccttcaccggcgacgactgcttcggcggcgagttcccgcccctctacaccgacttcgacctcctggccgacttcccggagccgtcgctggacttcctcgccgacctccccgaggagcccctctcgctgccgtccatcgagcgtgagaacaagtgctgggcaatggcagcg

SEQ ID NO: 345 - protein, 322 aa, Setaria italica
  Si002247m polypeptide
MWAMEEEMFVAVRRTEHVEVTSRAVEVAPAAAAGPRTVRVFCDDYDATDSSGDEDDEEAAVAARRRVKRYVQEIRLERAVKEAPAAKAAASSAAAAARTKLVLPGRKRKADGAEPRFRGVRRRPWGKYAAEIRDPWRRVRVWLGTFDTAEEAAKVYDSAAIQLRGPDATTNFEQVDDPVPTEVAERLPQPPPAAASKNASSSATSYDSGEESHAAAASPTSVLRSFPPSAVAEDTCGKKPAPAAQPAYRAPETDESSVDGSVFGCPFTGDDCFGGEFPPLYTDFDLLADFPEPSLDFLADLPEEPLSLPSIERENKCWAMAA

SEQ ID NO: 346 - DNA, 897 bp, Oryza sativa
  LOC_Os01g46870.1
atgtcccggtcgcgcacggtgcggatcttctgggacgaccccgacttgacagactcgtccggcgaggacgaggggtgcggcggccggagggtggggagcatggtgcgggagctgccgcctgcccagatgcccgtggcgcaggcaggttttgctcctgctgctgcagccgctgctgctgctttgccggagcagtgcagcggcggggacggtgatatgggaagaagggtcgttggtggcggatgcactgtgggtgtgggacggaggaggttgacgaaggacggagggcctggcgcgccgagcaccaagttccgcggcgtcaggcggaggccgtggggcaagttcgcggcggagatccgcgacccgtggcgcggcgtgcgcgtctggctcggcaccttcgacaccgccgaggaggccgcgcgcgtgtacgacaacgcggccatccagctccgcggccccagcgccaccaccaacttctccgcctccaccaactccgcgggtgcacaagatccggtggcagttggctacgagtccggcgcggagtcctcgccggcggtgtcgtccccgacgtctgtgctccgcaaggtcccgtccctgtgctccctggccgaggacaaggacgactatgaggccggcccctgcgagcccgcaactgccgccggttccaacctcaccgttctcgaggaggaggagctcggcgagttcgtgccgttcgaggacgcgccggtctacggcggcagcagcttctgggacttcgagcccgagtccggcttcctgtacgccgagccgtcgtcgcctgagacgccgtgggacgccggcgccacgtcctccggcgaggcccaagactacttccaggacttgcgcgacctgttcccgctcaacccgcttcccgcaattttc

SEQ ID NO: 347 - protein, 299 aa, Oryza sativa
  LOC_Os01g46870.1 polypeptide
MSRSRTVRIFWDDPDLTDSSGEDEGCGGRRVGSMVRELPPAQMPVAQAGFAPAAAAAAAALPEQCSGGDGDMGRRVVGGGCTVGVGRRRLTKDGGPGAPSTKFRGVRRRPWGKFAAEIRDPWRGVRVWLGTFDTAEEAARVYDNAAIQLRGPSATTNFSASTNSAGAQDPVAVGYESGAESSPAVSSPTSVLRKVPSLCSLAEDKDDYEAGPCEPATAAGSNLTVLEEEELGEFVPFEDAPVYGGSSFWDFEPESGFLYAEPSSPETPWDAGATSSGEAQDYFQDLRDLFPLNPLPAIF

SEQ ID NO: 348 - DNA, 909 bp, Zea mays
  GRMZM2G151542_T01
atgtcgcgctcgcgcacggtgcggatcttctgggacgatcctgacctgaccgattcctccggcgacgacgagggctgcggagcccggagggtcggcagaatggtgagggagctggcaccagcaccagcaccagcaccggcggctcttcccgtgccggatcagtgcaaccccggggacggcgaccgcgggaggaaggccggcgtcgctggtcccggcgtgtgcagcggggcgcggagacggctggccaagggcgccggtggcgcggcgagcaccaagttccgcggcgtgcggaggcggccgtggggcaagttcgcggcggagatccgcgacccgtggcgcggcgtgcgcgtctggctcggcaccttcgacaccgcggaggaggccgcacgcgtctacgacgccgccgccgtccagctccgcggggccaacgccaccaccaacttctccgcgtccgccgccactaactgcggctccggctccggggccggggccgggcaggacccggcgacgacaccggcggcgggctacgagtccggcgcggagtcgtcgccgacgtccgtgctccgcaaggtcccctccctgtcctccctcgccgaggacgactcggacgcgccggccgcccagcgccgcagcctggccgtcctcgaggaggaggagctgggcgagttcgtgccgttcgaggacgcgcccgtctacgccaccagcggcttctgggacttcgagcccgacgcggggttcctctacgccgagccgtcgtcgccggaggcgtcgtggaatgccgccgccgccgtcgccgagcccgcctcgtctgacgacgcgcccagctgggccgcgtcgccggtgcaggagaacgactacttccaggacctgcgcgacctcttcccgctaaaccggcttcccgcgattttc

SEQ ID NO: 349 - protein, 303 aa, Zea mays
  GRMZM2G151542_T01 polypeptide
MSRSRTVRIFWDDPDLTDSSGDDEGCGARRVGRMVRELAPAPAPAPAALPVPDQCNPGDGDRGRKAGVAGPGVCSGARRRLAKGAGGAASTKFRGVRRRPWGKFAAEIRDPWRGVRVWLGTFDTAEEAARVYDAAAVQLRGANATTNFSASAATNCGSGSGAGAGQDPATTPAAGYESGAESSPTSVLRKVPSLSSLAEDDSDAPAAQRRSLAVLEEEELGEFVPFEDAPVYATSGFWDFEPDAGFLYAEPSSPEASWNAAAAVAEPASSDDAPSWAASPVQENDYFQDLRDLFPLNRLPAIF

SEQ ID NO: 350 - DNA, 897 bp, Zea mays
  GRMZM2G160971_T01
atgtcgcgcccgcgcacggtgcggatcttctgggacgatcctgacctgacggactcctccagcgaggaggagggctgcgggacccggagggtgggcaggatggtgcgggagctgccacccatggcgggtgcggcggcggctgctcccgtgccggaccagtgcaacgccggggacggcgaccgcgggaggagactcggcgttgctgctcccggtgcgtgcagcggggcgcggagacggctggccaagactggcccgagcaccaagttccgcggcgtccggaggcggccgtggggcaagttcgccgcggagatccgtgacccgtggcgcggcgtgcgcgtgtggctcggcaccttcgacaccgcggaggaggccgcccgcgtctacgacaccgccgccatccagctccgcggggccaacgccaccaccaacttctccgccgccgctaactccggctccagggccggccagcgggacccggcgacccccggctacgagtccggcacggagtcctcgccggcggcgtcgtcgccgacgtccgtgctccgcaaggtcccctccctgtcctccctcgccgaggacgactcctgcgcggccccgtgcgagccagccgcggggtgccgcagcctggccgtcctcgaggaggaggagctcggccagttcgtgccgttcgaggacgcgccggtctacgccaccagcggcttctgggacttcgagcccgacgcggggttcctctacgccgaaccgtcgtcgccggaggcgtcgtggaacgccgccgccgccgccgagccggcctcgtccgacgacgcgcccagctgggccgcgtcgccggtgcaggagaacgactacttccagggcctccgcgatctcttcccgctcaacccgcttcccgcgattttc

SEQ ID NO: 351 - protein, 299 aa, Zea mays
  GRMZM2G160971_T01 polypeptide
MSRPRTVRIFWDDPDLTDSSSEEEGCGTRRVGRMVRELPPMAGAAAAAPVPDQCNAGDGDRGRRLGVAAPGACSGARRRLAKTGPSTKFRGVRRRPWGKFAAEIRDPWRGVRVWLGTFDTAEEAARVYDTAAIQLRGANATTNFSAAANSGSRAGQRDPATPGYESGTESSPAASSPTSVLRKVPSLSSLAEDDSCAAPCEPAAGCRSLAVLEEEELGQFVPFEDAPVYATSGFWDFEPDAGFLYAEPSSPEASWNAAAAAEPASSDDAPSWAASPVQENDYFQGLRDLFPLNPLPAIF

SEQ ID NO: 352 - DNA, 1026 bp, Oryza sativa
  LOC_Os06g06540.1
atggtggaagttatcgtggagaagaaggcgcgaaggattgtgagggggaggtggcatgtggaggcgagcaacgaagcggcggcggcggcgccggctgttgccgcgcccgcgcccagggttgttcgggttctctgcagagaccacgacgccacggactcctccggcgacgacgatggcgaggacgacgcgccgcggcgtgctcgcctcctcgtgcacgagatccacgtcgcgcggcagccggtggccatgtcgccagcggcggcgagctccagccagagacgtcgtgtcggcccgatgaagaggacggaatcggcggtggatgcgacgatggacgcgacggcggcggcgccggagaggaagttccgcggggtgaggaagcggccgtgggggaagtacggggcggagatccgcgtgtcgcagcagagcgcgcgcgtgtggctcggcacgttcgacaccgccgaggaggccgcgcgggtgtacgaccacgccgccctccgcctgcgcgggccgtccgccacgaccaacttccccatgacgccagcggcgccgtcgcctcctccctcgcgcgccacctacgccggcgcggcgtccgggtacgacgagtccagcgacgagtcgcagctcgtcggctcgccggtctccgtgctccgcccaatgccggcgcgcgcaacggccaagaaagaggccaaggaagaagacgactccgcccccgatatcctcggcatctccgccggcgacggcttaatctccccgttcacctgcgacgtcctgaatttcccaccgcccgacgaggacatgttcggcggcggcatctccttcggcgagccgacaccgccacccatggtgttcgacgacgactgcatggcgcgcctcggccacgcccccaacgacgacgagcacccggtgacgagctcgtccttcctcgacggcgatctcggcgacctgccgtcgtggacggaggtggacggcttcttcagcgacgtcggcggcgacgacctgttcgccgccgagccgttcccggcgctc

SEQ ID NO: 353 - protein, 342 aa, Oryza sativa
  LOC_Os06g06540.1 polypeptide
MVEVIVEKKARRIVRGRWHVEASNEAAAAAPAVAAPAPRVVRVLCRDHDATDSSGDDDGEDDAPRRARLLVHEIHVARQPVAMSPAAASSSQRRRVGPMKRTESAVDATMDATAAAPERKFRGVRKRPWGKYGAEIRVSQQSARVWLGTFDTAEEAARVYDHAALRLRGPSATTNFPMTPAAPSPPPSRATYAGAASGYDESSDESQLVGSPVSVLRPMPARATAKKEAKEEDDSAPDILGISAGDGLISPFTCDVLNFPPPDEDMFGGGISFGEPTPPPMVFDDDCMARLGHAPNDDEHPVTSSSFLDGDLGDLPSWTEVDGFFSDVGGDDLFAAEPFPAL

SEQ ID NO: 354 - DNA, 945 bp, Zea mays
  GRMZM2G328197_T01
atgccagaagcagctacggtcgtctacacggagaggaagcggaagatcaagaaggagcctgcagagacggccacggtccccaaactggttcgcgtcttctgcgacgaccttgacgccacggactcctccggcgacgacgaggctgccgccagtggcggtgttgcagcgcgtggggcacgtaagtttatcctggagatcttcacggaggggcatcgaaagggttgcaatgccacggcgactattccggcgcctggcggtggcaagaggaaagcgccggcgacgaccctggcgccggaggagccgaggtacaggggcgtgcggaggcggccgtgggggaagtacgcggcggagatccgcgacccgcacaagggcgagcggctgtggctggggaccttcgacaccgccgaggaggcggccagggagtacgacagcgcggcccgccggctccgcgggccgtcggcgacgaccaacttcccggcaccgccgacgccgtctgaccgtgttcctgccgtgcgcgagctctcctccgccgaagagtcggacagcgacgagacccacacggtgagctcgccggtgtccgtcctgcaggaggcaatgcctggcgagacggccgcagcagtggggcctccggcgccgaaacccacggacgacgccgccgatcccgcggcggccaagaaagacgcgccgaggggcgacggcggtctgtcgcacttctccgccgacgcgcccctgcctcagctcggcgacgatgcgttctccttcgcccctctcggcggcgtcccgttcgacgacttgcccgcgccgcagctcgactactgctacctcgccgacgactctgcgctcgacctcggcagcctccctatgtggcctggagtggacggctgccagttcagcgacatcagcgacgacgacctcttcgccctctcgggccccggcgcgccgaat

SEQ ID NO: 355 - protein, 315 aa, Zea mays
  GRMZM2G328197_T01 polypeptide
MPEAATVVYTERKRKIKKEPAETATVPKLVRVFCDDLDATDSSGDDEAAASGGVAARGARKFILEIFTEGHRKGCNATATIPAPGGGKRKAPATTLAPEEPRYRGVRRRPWGKYAAEIRDPHKGERLWLGTFDTAEEAAREYDSAARRLRGPSATTNFPAPPTPSDRVPAVRELSSAEESDSDETHTVSSPVSVLQEAMPGETAAAVGPPAPKPTDDAADPAAAKKDAPRGDGGLSHFSADAPLPQLGDDAFSFAPLGGVPFDDLPAPQLDYCYLADDSALDLGSLPMWPGVDGCQFSDISDDDLFALSGPGAPN

SEQ ID NO: 356 - DNA, 945 bp, Zea mays
  GRMZM2G429378_T01
atggtggaagccgcggcggtgagcagatcacgaccgaagatcaagcaggagcccgcggagacgaccgcgatctgcaaactagtccgcgtcttctgcgacgaccgcgacagcacggactcctccggtgacgaggctgccgccggtggtggtgctggagcggcggcgggggcgcgtaagttcctcgtggagatctccgtggagaagcaccagccgcgctgcaatgccatggcgcccgcggggagggctgctggcggtggcaagaggaaagcggcggcggctggcacgccggcggagccgaggtacaggggcgtgcggagacggccttgggggaggtacgcggcggagatccgcgacccgcacaagggcgagcggctgtggctaggcacgtttgatactgccgaggaggcggccaggaggtacgacagcgagacacgtcggctccgtgggccatcggcgatcaccaacttccccgcgacgcctgacgatcgtgtcccgcttccggcgccggcgctgtcgttgcacggcgttgctgccgtgggcgagcactcctccgccgaggaggagtcctgcgacgagtcccagctggtggtgggctcgccggtctccgtcctccgggcaatgcccgacgagacggcgcgtgcgactctgccgccgaaaatcgcggacgccgccgccggttgtgcgaccaagaaagacgcgcccgacggccgcggcggcctctccccgttctccgccgatgacgcgctcctgccccagctcggcgaggacgcgttctctttcggcggcgtcccgttcgacgacgacttgcccacgccgcagctcggcctcgactacctcgccgccgaccccgcgctcgacctcggcagcctcccgatgtggccaggagtcgacggctgccgcttcagcgacatcggcgacgacgacctcttctccctccccgcgctc

SEQ ID NO: 357 - protein, 315 aa, Zea mays
  GRMZM2G429378_T01 polypeptide
MVEAAAVSRSRPKIKQEPAETTAICKLVRVFCDDRDSTDSSGDEAAAGGGAGAAAGARKFLVEISVEKHQPRCNAMAPAGRAAGGGKRKAAAAGTPAEPRYRGVRRRPWGRYAAEIRDPHKGERLWLGTFDTAEEAARRYDSETRRLRGPSAITNFPATPDDRVPLPAPALSLHGVAAVGEHSSAEEESCDESQLVVGSPVSVLRAMPDETARATLPPKIADAAAGCATKKDAPDGRGGLSPFSADDALLPQLGEDAFSFGGVPFDDDLPTPQLGLDYLAADPALDLGSLPMWPGVDGCRFSDIGDDDLFSLPAL

SEQ ID NO: 358 - DNA, 912 bp, Setaria italica
  Si008428m
atggtggaagcagcccacaaggcggcagcgatccgcaaagtggttcgcatcttctgcgacgaccgtgacgccacggactcctccggcgacgaggccgaggccggcgccggcgtcgccacgccgcgaggagtgcgcaagtttgtgaaggagatccgcatggagcagcgtcgggccataacgtcatcggctcccgcgcccgccggtagagttgctcccggcggtggtggcaagaggaaactgccgggcgttccggcggcggcgcgcgcggcggagccaagctacaggggcgtgcggaggcggccgtgggggaagtacgcggcggagatccgcgacccgcacaagaacgcgcgggtgtggctgggcaccttcgacacggccgaggaggccgcgaggatgtacgacagcgaggcccgccgcctccgcgggccatcggcgacgaccaacttccccgcagcgccgccgaaacccgtccgtgtggtgccgccgccccaggccattcccgccgtagtggccgacctctcctccgccgaggagtccagcgacgagtctcagctggtgggctcgccggtctccgtgctccccgcaatgccgggcgagacgacggacgacgcggtggccccgctggcgctaaagcccacggacgccaccgattccaccgccaagaaagacgcctcccccttctccgccgacgcgatcctcccggagctcgaggagggcgtgttccccggcatcatcaccccgttcgacgacccggccctaggcgtcctgttcgacgacatcgccgcgccgcggctcgaccacctccccgacgacggccacctcggcgacctcccgatgtggccgggcgaggacggctgcggcttcagcgacatcggcgacgacttcttcgccgccgagccgctccccgccgtc

SEQ ID NO: 359 - protein, 304 aa, Setaria italica
  Si008428m polypeptide
MVEAAHKAAAIRKVVRIFCDDRDATDSSGDEAEAGAGVATPRGVRKFVKEIRMEQRRAITSSAPAPAGRVAPGGGGKRKLPGVPAAARAAEPSYRGVRRRPWGKYAAEIRDPHKNARVWLGTFDTAEEAARMYDSEARRLRGPSATTNFPAAPPKPVRVVPPPQAIPAVVADLSSAEESSDESQLVGSPVSVLPAMPGETTDDAVAPLALKPTDATDSTAKKDASPFSADAILPELEEGVFPGIITPFDDPALGVLFDDIAAPRLDHLPDDGHLGDLPMWPGEDGCGFSDIGDDFFAAEPLPAV

SEQ ID NO: 360 - DNA, 714 bp, Zea mays
  GRMZM2G009598_T01
atgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaaccggctggggcaagctcggccgttcggttccgtggcgtccgtcgtaggccgtgggggcgctgggctgcggagatccgcgagccgcacaaccgccgcagactgtggctcggcaccttcgacaccgctgaggaggctgccaacgcctacgacgctgcgaacatccgcttccgcggtgtcagcgccactaccaacttccctgcggcccgctactcgccccctccaaagccagcgaagcctatcatctcgctgactcctgaacccggaaaggtgatcaccttgccaccggtacctgtgaagccaaccttccctgttcaggtgaaggaagtgggtgggagctggggcggcctggtcaagggagctaggtcggaggtcaaggcgtttgcaccgaagccagtatggaagatgatccccagggtgcaccagaagtttccgggttgtgccgatggctctggcctgcgtgccgtccatgctgcctccatctacgtggaggaggttggcggtggc

SEQ ID NO: 361 - protein, 238 aa, Zea mays
  GRMZM2G009598_T01 polypeptide
MGTNPHLQELAASAVAASEPPPRARVVRILVHDADATDSSSSEDEAPPLLPRRRSRGGSSSLSVRRRVMEPAGASSAVRFRGVRRRPWGRWAAEIREPHNRRRLWLGTFDTAEEAANAYDAANIRFRGVSATTNFPAARYSPPPKPAKPIISLTPEPGKVITLPPVPVKPTFPVQVKEVGGSWGGLVKGARSEVKAFAPKPVWKMIPRVHQKFPGCADGSGLRAVHAASIYVEEVGGG

SEQ ID NO: 362 - DNA, 732 bp, Setaria italica
  Si037209m
atgggtccaaaccctagcctgcaacagctggccgcggcggcggcggaggtggcgatgacggcgtccgagccgccgccgccgccgcgcgcgcgcgtggtgcggatcctcgtgcacgatgctgacgctaccgattcgtcctccagcgaggatgaggcgccgccgcctccgcggagggcgagggttggcagcagcagcgtgggcgcgaggcgccgcgtgatggaagcggccggggctaatccgcccgtacgcttccgtggcgtccgccggagggcgtgggggcgctgggcggcggagatccgcgacccgcacggcagccgccgtatctggctgggcaccttcaacagcgcggaggaggccgccgctgcctacgacgttgcaaacattcgcttccgcggtgccagcgcccataccaactttccccccgctcgctacttgctgccactagagccagccaagcctatcatctcgctgactcctgggccaggaaaggtgatcaccttgccaccagtacctgtgaaatcgaccgtccctctgcaggtgaaggtgaaggaggagggtgggagctgtgacggccagggggaggaaggtagttcggaggtcaaggcctttgcaccaaggccgatgtgggagatgatccctgggaagcgcaagaagcgtccgggctgtggcagtggcactcgcctgcgtgccattcatgctgcctctgtctgcgtggaggaggttggcggagcc

SEQ ID NO: 363 - protein, 244 aa, Setaria italica
  Si037209m polypeptide
MGPNPSLQQLAAAAAEVAMTASEPPPPPRARVVRILVHDADATDSSSSEDEAPPPPRRARVGSSSVGARRRVMEAAGANPPVRFRGVRRRAWGRWAAEIRDPHGSRRIWLGTFNSAEEAAAAYDVANIRFRGASAHTNFPPARYLLPLEPAKPIISLTPGPGKVITLPPVPVKSTVPLQVKVKEEGGSCDGQGEEGSSEVKAFAPRPMWEMIPGKRKKRPGCGSGTRLRAIHAASVCVEEVGGA

SEQ ID NO: 364 - DNA, 885 bp, Citrus clementina
  clementine0.9_017304m
atgaatcagttagtttcttcatcatctggagccaaatacagagagcagcgaagcacgacgacaacggttgtaaaaccatcttgttcaggaacaaaagttatacgtgtttcggtgacggacggtgatgcgacagagtcatcaagcgatgaagatgaagagaggggagcgagagtgaagaagcagataaacgaaatcagaattgtagagtgttcaaaatcaaacgaaatcagttgttcagagagtgtgaaacagagaatgaaagacagaagcattccgttgaaaaaaagagtgggcggtagatcatacgacaacaaatatcgaggcgtgagaatgcggccgtggggcaaatgggctgccgagattagagacccgtttcaacgaaccagggtgtggctggggacttttgaaacggcagaagaagctgctcttgtttatgatcaagctgctattcgtcttaaaggccctcacgctcaaaccaatttcttgaggccaccccaaaccgatcaaacatttgattttgtaacgagcggctatgattccgaaaaagagtctcagtctcagactccaacgtccgcaataccttccccgacgtccgttctcaggttccactccaacgaggaaattgagctcgcaaaaacagagttgtttaatcttgagagtgatcgctgttgtccgtctcaggatagtttccagatttatgattcggagctgttggattctgcaactccggctccaatctttttcgatgataagatgtgtgtgccgcttttgaaagaaaatttgggtgacgtttctgtcgatttaggcggggatttcgattcatgcatttcggagtgggacgtcgataattactttcaagatcctcctcctttgcccgattcgcat

SEQ ID NO: 365 - protein, 295 aa, Citrus clementina
  clementine0.9_017304m polypeptide
MNQLVSSSSGAKYREQRSTTTTVVKPSCSGTKVIRVSVTDGDATESSSDEDEERGARVKKQINEIRIVECSKSNEISCSESVKQRMKDRSIPLKKRVGGRSYDNKYRGVRMRPWGKWAAEIRDPFQRTRVWLGTFETAEEAALVYDQAAIRLKGPHAQTNFLRPPQTDQTFDFVTSGYDSEKESQSQTPTSAIPSPTSVLRFHSNEEIELAKTELFNLESDRCCPSQDSFQIYDSELLDSATPAPIFFDDKMCVPLLKENLGDVSVDLGGDFDSCISEWDVDNYFQDPPPLPDSH

SEQ ID NO: 366 - DNA, 975 bp, Eucalyptus grandis
  Eucgr.E00834.1
atgcctccggtcaagttcactgaacactgcactcacaccacgctcgtgagaccggaccaccatctcaacagcccgaagacccgacccgagatgaacccgaaagtcctcagaatatcctacacggacggcgacgccacggactcctccagcgacgacgaagaggccgagctgctccctcgccggcgagtcaagaagtttgttcacgagattgctctgcagtccgacggcggagacggggacgccggctccgggagggctaaggcgaagcgccggaagccctccgggaatcccgggactccggtcagcggcggggacttgaaggcgtccaccggcggtgggaagaagttccggggcgtgaggcagaggccatggggaaagtgggcggcggagattcgagacccgaaaaaagggacgcgggtgtggctgggaacattcgggaccgccgaagaggccgccttggtttacgacaacgcggcgatacagctgcgcggacccgacgcgctcaccaacttctcgacgccgcctgcagaatctatgccgccgccgccgccgaagaacggtgtcgtccctcctctgccgccgaccgcagccgccgcgacggcgagcagctcgagctcggtgtccggcgagggctcgtcccgccgcgcctcttctccgacctcggttctccggggcgtctctggcgaggaagccgactcgccggtgggcgaagcggcgaaggagtcgtgcgtgtcggagaacttcccgcagccctccgcccggtcggcgttggacttgtacttgccggccgaaaccttcggtttccagagctccaggtcggacttgtccggctccttctccggcctctacaccggcgacgacttgctcgctaatctcggcgacgatctgggggccgggttcgggtcccctgactggaccttctacgatcacgttcgcgacgtcggggacatactcaggttggacccccatgtaaag

SEQ ID NO: 367 - protein, 325 aa, Eucalyptus grandis
  Eucgr.E00834.1 polypeptide
MPPVKFTEHCTHTTLVRPDHHLNSPKTRPEMNPKVLRISYTDGDATDSSSDDEEAELLPRRRVKKFVHEIALQSDGGDGDAGSGRAKAKRRKPSGNPGTPVSGGDLKASTGGGKKFRGVRQRPWGKWAAEIRDPKKGTRVWLGTFGTAEEAALVYDNAAIQLRGPDALTNFSTPPAESMPPPPPKNGVVPPLPPTAAAATASSSSSVSGEGSSRRASSPTSVLRGVSGEEADSPVGEAAKESCVSENFPQPSARSALDLYLPAETFGFQSSRSDLSGSFSGLYTGDDLLANLGDDLGAGFGSPDWTFYDHVRDVGDILRLDPHVK

SEQ ID NO: 368 - DNA, 915 bp, Populus trichocarpa
  POPTR_0002s16900.1
atgaatcgcttttctaccaagtacacagagcataaaactgtgaccaacaagctggtgaaatgggaggactcaaaagccacaagaatagtacggatttcagttaccgatggcaatgctacggactcgtctggtgatgaaaaggaggaatcgaaaaggcatcatccaagagtcaaaaaacatataaacgagataagaataacaagttgtgggagcgacagagcagcagaagatgcaaaaaaatcttcaaaagtggtaagccggcaacaagttgtgaaaaaaatttcaagggatcagtgttcttatccaggggggaaaaggtatcgtggtgtgagacaaaggccatgggggaggtgggcagcagagatcagagacccttataggagaacccggctatggttagggacttatgatacagcagaggaggcagccatggtttatgatcaggctgctattcgtattaaaggacctgatgcacaaaccaatttcacacaacctccggtgagcaaacaacatgccccagatgttgatattaacgttaacatttctgggtatgagtctggtaaagaatctcataatagtctgtgttctccaacttctgtgcttagatttcaatctacagaggaaccggggccagagtcacaggttgccgtacagagtgattgttgctggaggatacaaacgcaagaagaggttgttcaagaagaaataataaaggtcggtgaggatgatgagtgtttggttacggatcctttgtgtttgaaagagttttgggattttgaaaatcctgctccgattttttttgaggagtgtagtgtaccggatactgttttgagagaagattatgctgatatctcggtacatttggatggtgatttcggctcctgtttatgggatgtcgacaagtactttgaggct

SEQ ID NO: 369 - protein, 305 aa, Populus trichocarpa
  POPTR_0002s16900.1 polypeptide
MNRFSTKYTEHKTVTNKLVKWEDSKATRIVRISVTDGNATDSSGDEKEESKRHHPRVKKHINEIRITSCGSDRAAEDAKKSSKVVSRQQVVKKISRDQCSYPGGKRYRGVRQRPWGRWAAEIRDPYRRTRLWLGTYDTAEEAAMVYDQAAIRIKGPDAQTNFTQPPVSKQHAPDVDINVNISGYESGKESHNSLCSPTSVLRFQSTEEPGPESQVAVQSDCCWRIQTQEEVVQEEIIKVGEDDECLVTDPLCLKEFWDFENPAPIFFEECSVPDTVLREDYADISVHLDGDFGSCLWDVDKYFEA

SEQ ID NO: 370 - DNA, 942 bp, Populus trichocarpa
  POPTR_0014s09020.1
atgttttcacccaaaaaccaaacccacaagagacttgattgcattaaaaaaatggatcgcttttctaccaaatacacagagcataaaaccgtgaccaacaagctggtgagatgggaggactcaaaagccacaagaattgtaaggatttctgtgactgacgggaatgcaacggactcctctggagatgaaaatgaggaacccaagatccaacatccaagaattaaaaagcatatcaacgagataagaatgacaaattgcagcgacagggaagcagaggatgcgaaaaaatcaccaggacagcaagttgtgaaaaaaaactcaagggatcagtattattatccagaagggaaaaagtatcgtggtgtgagacaaaggccatgggggagatgggcagcagagatcagagacccttataggagaacccgggtatggttagggacttatgacacagcagaggaggcagccatggtttatgatcaggctgctattcgtattaaaggacctgatgcacagaccaatttcacaaacactctggtgagcaaacaacataccccagatgttgatattaatgttaacatttctgggtatgattctggtaaagagtctcataatagtctatgctctccaacttctgtacttagatttcattccactggggaaccgggtccagagtcacaggctgctgtacagagtgactgttgctggagacaaaatcaagaggtcgttcaagaagaaatattgaagggtggtgatgatgagtgtttggtgatggatcctctgtgtttgaaggagttttgggactttgaaagtcctgcaccgattttttttgaggagtgcagtgtaccgggtactgttttgagagaagattatgctgatatgccggtacatttagattgtgattttggttcctgtttatgggatgttgacaagtattttgaggca

SEQ ID NO: 371 - protein, 314 aa, Populus trichocarpa
  POPTR_0014s09020.1 polypeptide
MFSPKNQTHKRLDCIKKMDRFSTKYTEHKTVTNKLVRWEDSKATRIVRISVTDGNATDSSGDENEEPKIQHPRIKKHINEIRMTNCSDREAEDAKKSPGQQVVKKNSRDQYYYPEGKKYRGVRQRPWGRWAAEIRDPYRRTRVWLGTYDTAEEAAMVYDQAAIRIKGPDAQTNFTNTLVSKQHTPDVDINVNISGYDSGKESHNSLCSPTSVLRFHSTGEPGPESQAAVQSDCCWRQNQEVVQEEILKGGDDECLVMDPLCLKEFWDFESPAPIFFEECSVPGTVLREDYADMPVHLDCDFGSCLWDVDKYFEA

SEQ ID NO: 372 - DNA, 1101 bp, Citrus clementina
  clementine0.9_013577m
atggagcaaagcagcagtctgtgtccgattaaatacacagtacatcgaaatgttacaaagaaattcacaaaaccatctctgaaatccaataaaagaatcgccgatgaacggagggtggtacggatattgaccaccgaccacgacgccacggactcatcaagcgacgaggaaggagagttcttcagccgccagcgggtgaaacgctacgtgagcgaaatcaacattgagacgagctgcagcagcagcagcaagaacagcagtagcaacgccgcgggagccgttggcagtaacagaaagagagtggcagcggacaatatgaataatgatgcagcacggccgttaaggcaggcttcgcaaacgacgaatgggaagaagtttcgtggcgtacggcagaggccgtgggggaaatgggcggctgagattagagatcccgcgagacgtgtacggttgtggcttggtacttacgacacagctgaagaggctgcccgggtatatgacaacgccgccatcaaacttcgaggtcccgacgctttgacaaatttctcgacgccaccgcctgctgttgaagttgaggttgaagtagaaaagcccgaaacaacaatcaacgtatcggctacggctacggtttcgggttacgaatcgggtgaagagtctcactgtcacaatctctcctcaccaacttctgttctcaatttcagaacccattcgagcgaagagtctgaacaagaaaagccgccgaaagatgaagagattcaaggagaaacgacgacgaccgcggttttgtgtgacgattcctcagggggaggcgactatttgccgttggatttgccatttctcgacgagtttttcagcaacgtgccaacacctgggctgtcgtttttccacgacgacggcggcaaccctgctgctccgatgtttcaagacagcatcttcttcagtactgacgagtttctcgatacggtgcctcaagattttggtggtgatttcacattctcaacgacgtcgtcctatccttcttcttctgcgctatgtcaagtggacgactatttccaagacatcggcgatttgttctccgctgaccctccgcttgttggaggactt

SEQ ID NO: 373 - protein, 367 aa, Citrus clementina
  clementine0.9_013577m polypeptide
MEQSSSLCPIKYTVHRNVTKKFTKPSLKSNKRIADERRVVRILTTDHDATDSSSDEEGEFFSRQRVKRYVSEINIETSCSSSSKNSSSNAAGAVGSNRKRVAADNMNNDAARPLRQASQTTNGKKFRGVRQRPWGKWAAEIRDPARRVRLWLGTYDTAEEAARVYDNAAIKLRGPDALTNFSTPPPAVEVEVEVEKPETTINVSATATVSGYESGEESHCHNLSSPTSVLNFRTHSSEESEQEKPPKDEEIQGETTTTAVLCDDSSGGGDYLPLDLPFLDEFFSNVPTPGLSFFHDDGGNPAAPMFQDSIFFSTDEFLDTVPQDFGGDFTFSTTSSYPSSSALCQVDDYFQDIGDLFSADPPLVGGL

SEQ ID NO: 374 - DNA, 1074 bp, Eucalyptus grandis
  Eucgr.A02669.1
atggaccagagcatcctatgccccatcaagtacaccgagcaccgaagcctaacccggaaactcctgtccaagcaactcaggaacgacgtccccaacccgccccggaccgtacggatatcggtgaccgacccgtacgccacggactcgtccagcgacgacgacgacgagggcgacgccgccgagtcgttcttccgccgccagcgcgtgaagcgctacgtcagcgagatcaagttcgaagccgcctccaggagcggcgggggctcgagcggcggcggcggccgcaggaggagctgctccgggggcgagtcggccccggccgatctgaggacgcggccctcgctgaaggtctcgcccgcggcggctgcggcgggcgggaagaagttccgcggcgtgcggcagcggccgtgggggaagtgggccgcggagattcgcgaccccacgcgccgcgtgcggctgtggctgggcacctacgacacggcggaggaggccgccatggtctacgacaacgccgcgctcaagctccgcggccccgacgcccagaccaacttcgccacgccgtcgccgagcaaagagccctcgccggagaacgagatcctcgcggcctcctccctctccgggtacgagtccggagaggagtctcacaacctctcgtccccgacttccgtcttccacttccggactcactccaacaacagcgctgatgccgacccggccggaccgccgcctcaggagccggccgacgaagcccgcgactacccggagtgcgagggcgagacgagcttggccgattcgagcgagtacctgcggctggacttgccgttcctcgacaacttttacaacaacttcgactccccgctggagccgtcgctgttcgaggacgcccgcaacccggccctcccggagagcagcatgctgagcctgagcgacgacccgagcgacgtcttcacgagcgacgtcttcctcgacgccacgtcgtcggacgacttcgggtcgctgccgatggacatatgccaggtcgacgactacttcgacgagatcggcgactggctctcgtcggaccctttccccgtcctt

SEQ ID NO: 375 - protein, 358 aa, Eucalyptus grandis
  Eucgr.A02669.1 polypeptide
MDQSILCPIKYTEHRSLTRKLLSKQLRNDVPNPPRTVRISVTDPYATDSSSDDDDEGDAAESFFRRQRVKRYVSEIKFEAASRSGGGSSGGGGRRRSCSGGESAPADLRTRPSLKVSPAAAAAGGKKFRGVRQRPWGKWAAEIRDPTRRVRLWLGTYDTAEEAAMVYDNAALKLRGPDAQTNFATPSPSKEPSPENEILAASSLSGYESGEESHNLSSPTSVFHFRTHSNNSADADPAGPPPQEPADEARDYPECEGETSLADSSEYLRLDLPFLDNFYNNFDSPLEPSLFEDARNPALPESSMLSLSDDPSDVFTSDVFLDATSSDDFGSLPMDICQVDDYFDEIGDWLSSDPFPVL

SEQ ID NO: 376 - DNA, 1248 bp, Populus trichocarpa
  POPTR_0012s01260.1
atggcacttccacaccgatttctgagtcatccttgtctttcgtttatctcttcacaactagcaatcttctccttcacagttttgttctctctctatgcaagtagggagcttttggaggaattaattagaaggaaaaagaaaatcccagaaaatatgatagaccaaagtatcctatgtcccataaagtacactgagcacaaaaaagttacaaaaaaattcactaaacaacccttaaagcctaatatggtacactccgatgaccgatgccgctcaccggaaccctcaaacccggcaccaaggcttgttagagtgacagtcaccgaccatgacgccactgactcctccagtgacgaagagggagagttgtttggccggcaaagagtgaaaagatatgtgagcgagatcaacatccaaccggcagctttctgcaaagaaaccaatgtcattgctactactattgccaaaaaccggaaaagaagtgttggtgatatccctcaaaagccagcgaaaagacttactgcccaatcaaccaccaatggcagaaagttccgtggcgttcggcaaaggccctggggtaaatgggctgcagagatcagagatcctgctagacgtgtgcggttatggctagggacttacgacaccgctgaggaggctgcaagagtgtatgataatgctgccatcaagcttcgagggccagatgctttaacaaatttcaccacaccacctagtagggaggaggatcaagaagaagagaaaagtagtccagtggaggaatcagaagaaaagaagccagagattaacgtggaaacagtatctggctccggctatgaatctgctgacgagtctcacagtctgtcatctccaaaatctgtgctcactttcagactaccttcggctgaatcacacaaaccaccgtctcaacctttccaagaagctaaaatggagccaaagcatcaagacaatgaagaagccttcggcgagagcaatttgtctgattatttaccactggactcgccatttcttgatgattttttcaattttggaacatcagggccaaccctctttgacgatcaagttatagcgacgacgacgacagcaacatcaattttccaagagagtattatgtgtgatcaagattttggcgacatatttcttgacccacttcaagattttacttcattaccatcggtttgccaagaggatgatgattttttccatttcttaaactcagaacctcttacagcactt

SEQ ID NO: 377 - protein, 416 aa, Populus trichocarpa
  POPTR_0012s01260.1 polypeptide
MALPHRFLSHPCLSFISSQLAIFSFTVLFSLYASRELLEELIRRKKKIPENMIDQSILCPIKYTEHKKVTKKFTKQPLKPNMVHSDDRCRSPEPSNPAPRLVRVTVTDHDATDSSSDEEGELFGRQRVKRYVSEINIQPAAFCKETNVIATTIAKNRKRSVGDIPQKPAKRLTAQSTTNGRKFRGVRQRPWGKWAAEIRDPARRVRLWLGTYDTAEEAARVYDNAAIKLRGPDALTNFTTPPSREEDQEEEKSSPVEESEEKKPEINVETVSGSGYESADESHSLSSPKSVLTFRLPSAESHKPPSQPFQEAKMEPKHQDNEEAFGESNLSDYLPLDSPFLDDFFNFGTSGPTLFDDQVIATTTTATSIFQESIMCDQDFGDIFLDPLQDFTSLPSVCQEDDDFFHFLNSEPLTAL

SEQ ID NO: 378 - DNA, 1089 bp, Populus trichocarpa
  POPTR_0015s06070.1
atgatagaccagagtatcctatgtcccataaaatacactgaacacaaaaaagttacaaaacaattcacaaagccatccttgaagcctaaaaagttaccctccgatgaccggtgccgcttactagaaccatcaaacccacagccaaggctcgtcagagtaacagttaccgaccatgatgccacagactcttctagtgatgaggagggagggttgtttggccggcaaagggtgaaaagatacgtgaacgagatcgacatccaagccagctgcaaagaaactaatgccattactactgctgttgccaataaccggaaaagaggtgtcggtgatattcctcaacggccagcgaaaaaatctgctcctcaatcaactaacaatggcagaaagttccgtggcgttcggcaaaggccttggggtaaatgggctgcagagattagagatcctgctagacgtcagaggttatggttagggacttacgacacagctgaggaggctgcaagagtgtatgataatgcggccatcaagcttcgagggccggatgctttaacaaacttcatcacaccgcctagcagggaggaggagcaagaacaagagaaaagtacagtggaagaacgagaaggagaagaaaagaagaagccggaaatcaatgtcgacacagtttctggctccggttatgaatctgctgatgagtctcacagcctgtcatcaccaaaatctgtgctcacgttcagattaccttcggctgaatcacacaaaccaccggcccatcccttccatgaagttgaaaaggagccaagttatcaagacaatcaagaagcgttcggggagagcaactcgactgactatctaccactagacgcgccgtttcttgatgattttttcaattttggaacctcagggcctacactctttgatgatcaagttatggcgacggcgacaacatcggtttttgaggagagctttatgtctaatcaagattttggtgacatatttcttgacccacttcaagattttagttcgctatcatcggtctgccaggaggatgatgatttcttccatttcttaaactcggaacctctggcggcactt

SEQ ID NO: 379 - protein, 363 aa, Populus trichocarpa
  POPTR_0015s06070.1 polypeptide
MIDQSILCPIKYTEHKKVTKQFTKPSLKPKKLPSDDRCRLLEPSNPQPRLVRVTVTDHDATDSSSDEEGGLFGRQRVKRYVNEIDIQASCKETNAITTAVANNRKRGVGDIPQRPAKKSAPQSTNNGRKFRGVRQRPWGKWAAEIRDPARRQRLWLGTYDTAEEAARVYDNAAIKLRGPDALTNFITPPSREEEQEQEKSTVEEREGEEKKKPEINVDTVSGSGYESADESHSLSSPKSVLTFRLPSAESHKPPAHPFHEVEKEPSYQDNQEAFGESNSTDYLPLDAPFLDDFFNFGTSGPTLFDDQVMATATTSVFEESFMSNQDFGDIFLDPLQDFSSLSSVCQEDDDFFHFLNSEPLAAL

SEQ ID NO: 380 - DNA, 996 bp, Citrus clementina
  clementine0.9_015380m
atggttaatagcagacacagtgttatccctccagtcaagtacactgaacaccgtaaacacaccaagctcatgactccattctcaacaaacggccaggaaatgaagccgagagttgtacggatttcagtcaccgacggagatgcaactgactcgtccagtgacgaagactgcgaagtttataagagaccgcgtgtcaagaagttcttaagcgagattatgattgcatcgtcttcatcttcaagcgaaatcgatgtcgtttcaaagagtcggatttcgaaatgtaagaagaagaagaagtccggcaaagttggagctccggcgacccttaagccggcggcgaagcaaccggcggggaagaagtttagaggtgtacggcagagaccttggggaaaatgggccgctgagattagagatcctctgcgacgtgtacgactgtggttaggtacctatgatactgctgaggaggcggcaatggtttatgacaacgccgctattcagttgcgtggacccgacgcgctcaccaacttcgctactccacctccgaaattcccttctcagattaagcagtcgcttagctccggttacaactccggcgaagagtctcacaacaacatcaacaatctgtcatctcctgtttctgtactccgttgtccctctccttcaaatgaagaagccgagtcgcggactagcaaagaatcgccagatattgccagtgatatgcgagaaatgcgcgacgaatcctctgtgtccgaaactttgtccgccttctccgaatattcaacttttgataatacgttatttcctaacgatattttcgatttcaaaagttccgtgcccgatttatttggctgtacggaagggatttttaaagatgactgggacggtttattttatgactccagtatggacttcgggttcgggttgtcaacctggcgcgcggatgaccattttcaagatatcggagatatattcgcgtcggataaccttgttgctatt

SEQ ID NO: 381 - protein, 332 aa, Citrus clementina
  clementine0.9_015380m polypeptide
MVNSRHSVIPPVKYTEHRKHTKLMTPFSTNGQEMKPRVVRISVTDGDATDSSSDEDCEVYKRPRVKKFLSEIMIASSSSSSEIDVVSKSRISKCKKKKKSGKVGAPATLKPAAKQPAGKKFRGVRQRPWGKWAAEIRDPLRRVRLWLGTYDTAEEAAMVYDNAAIQLRGPDALTNFATPPPKFPSQIKQSLSSGYNSGEESHNNINNLSSPVSVLRCPSPSNEEAESRTSKESPDIASDMREMRDESSVSETLSAFSEYSTFDNTLFPNDIFDFKSSVPDLFGCTEGIFKDDWDGLFYDSSMDFGFGLSTWRADDHFQDIGDIFASDNLVAI

SEQ ID NO: 382 - DNA, 957 bp, Eucalyptus grandis
  Eucgr.D01775.1
atggaagccacgacgtgtttcgtgcctcctgtgaagctcaccgagcatcgaacccgcgcgaggctcctgagtcccgagcctgcggacgaccccagcatccgacccagagtcgtccggatatcgtacacggatggcgacgccaccgactcgtccagcgacgaagaggacggcccgttcgaatgtcgtcgccggagagtgaagagattcgtccacgagattgccatcgacccgccgtgctcgagagagagccacgaggtcggcaagagccggtcactgaggagcaagctgtgcggaaagtcgacggggaagccggcgctgcgggcgggccgctgcgagatgaagtcgccggcgggggtgaggaagttccggggcgtgaggcggaggccctgggggaaatgggcggccgagatcagggacccgctgcggcgcgtgcggctctggctgggcacctacgacacggcggaggaggccgcgatggtctacgaccaagcggcgatccagctgcgcgggcccgacgcgctcaccaacttcgccacccctccgccgctggaggtggccgcgatgtcccccccgatgcccccggcgaagggccctggcgaggcccgctcgccgacgtcggtcctccggtgcctccccgactacgccgaggactcgcaggggagcgccggcgacgagtcgtgcgcgtcggcgaacgcgtcggagcacgccgcgagcttcgagagcttgctcccggacgatttcttcgacttccggagctccgccccgagcttgttcgacgagtacgcgagcttcggagagagcatgttcaaggacgatgtggtcgacgccttcatgaacccgggcgaggatttcgggttcggattctgctccgggtccgggtcctcctgttggaccgtcgacgacgatcacttccaggacattggggacttgttcggctccgaccctctgttagcaatg

SEQ ID NO: 383 - protein, 319 aa, Eucalyptus grandis
  Eucgr.D01775.1 polypeptide
MEATTCFVPPVKLTEHRTRARLLSPEPADDPSIRPRVVRISYTDGDATDSSSDEEDGPFECRRRRVKRFVHEIAIDPPCSRESHEVGKSRSLRSKLCGKSTGKPALRAGRCEMKSPAGVRKFRGVRRRPWGKWAAEIRDPLRRVRLWLGTYDTAEEAAMVYDQAAIQLRGPDALTNFATPPPLEVAAMSPPMPPAKGPGEARSPTSVLRCLPDYAEDSQGSAGDESCASANASEHAASFESLLPDDFFDFRSSAPSLFDEYASFGESMFKDDVVDAFMNPGEDFGFGFCSGSGSSCWTVDDDHFQDIGDLFGSDPLLAM

SEQ ID NO: 384 - DNA, 867 bp, Glycine max
  Glyma11g02140.1
atgactgcgccaccgacgaagtacactcaccacaccaaactactcataccccccgaagaagacccacccaaacaccattatcccagactcgtcagaataaccgtcactgacaccgacgccaccgactcctccagcgacgaagaagaagaacaaacataccactgcaactcttccacgcgccaccgacataggaagttcgtcaatgagatttctatcgagtcgtgctccagcgagaacgacggcgtcgtttcgaggaagcgaattcgaagaagaagcaccactacgcccaaagcgacaagagcttcagacactcggcgcgtgtccgacggtaagaaattccgcggagtgagacagaggccgtggggaaaatgggccgcggagatacgagacccagcgcgacgcgttcggttatggttgggtacctacgacactgctgaggaagccgctttggtgtacgacaacgccgccattaagctgcgtggaccccacgcgctcaccaatttcataacgccaccttccggggaggaaactcattgcaatagcaagaatatcttttctcccacttccgtgcttcactgttgctccttgtccgaggaagctgagtccgttacggccaaagacgatgactactcctcggtgtcggagaataaggtcaaagctgagtcagcgtttccgcccgaaatagattttgagtttcgagcttgttcgactgtgccggagagtctgttgttctgcgatgatgattggtctagtgagtttctcaattcttatgaagatttcggtttcaaaagttggcatacggacagaaatcgtgactttttccaagatatcgacgatttgtttgtctcggatcccctccttgctctc

SEQ ID NO: 385 - protein, 289 aa, Glycine max
  Glyma11g02140.1 polypeptide
MTAPPTKYTHHTKLLIPPEEDPPKHHYPRLVRITVTDTDATDSSSDEEEEQTYHCNSSTRHRHRKFVNEISIESCSSENDGVVSRKRIRRRSTTTPKATRASDTRRVSDGKKFRGVRQRPWGKWAAEIRDPARRVRLWLGTYDTAEEAALVYDNAAIKLRGPHALTNFITPPSGEETHCNSKNIFSPTSVLHCCSLSEEAESVTAKDDDYSSVSENKVKAESAFPPEIDFEFRACSTVPESLLFCDDDWSSEFLNSYEDFGFKSWHTDRNRDFFQDIDDLFVSDPLLAL

SEQ ID NO: 386 - DNA, 1041 bp, Populus trichocarpa
  POPTR_0001s10300.1
atggatcatccagtcaagtttagtgagcatagaaaccaaaccaaactcacaacctcatttttatcgaatccagtccaacactctaaacctccaaaaattgtacggatatcagtaacagacacttatgcaactgactcttcaagtgacgaagaaaacgaggttgcagcaggctcttcccataaacgacatgtcacaagggtcaaaaagtttgtcaatgaaatctctatagagccaccatcatcatcaagaagtgctgactgtgtcccagtcgacacggttttggggaccaaaccgtcgaggagtgctaggaagaaggttggcgataatgggtctcggacgagacgttttccgtcgaaggcaacggcaacggtggtggtggggaagaaatttagaggggtgagacaaaggccgtgggggaaatgggcggctgagattagagatcccttgagacgtgtacggctgtggttaggcacttatgatactgctgaagaagctgctatggtttatgacaacgcggctattcagttgcgtggacccgacgccctcaccaactttgtcactcctccggctaggtgctcaccgctggcagccacctccgggtacatctccggtgacgagtcaaatagtaactataatattaacaatgacggtgttgttaatgtgagctctccaatctcagtgctccggtttagtgaagaggccgagactcaaagtgccagctcaagtagagaaatccgagataccggaactgaggttcctgaagtaaaagaggactcctgtgtatcggagaacttgtccgatttttcggagtataattcctcgatcgacagtctgtttcctcccacaaccgacatttgtgaacttcggagttcaatgaggaatattttcgaggaaacaagttttgctgctggtgggtttttgaaagatgatgatttcagggacatggatttggatttcggcttcggtttatcaagttggaatgtgcaagaccattttcaagatattggagatttgttcgggtcggattctcttatagctttt

SEQ ID NO: 387 - protein, 347 aa, Populus trichocarpa
  POPTR_0001s10300.1 polypeptide
MDHPVKFSEHRNQTKLTTSFLSNPVQHSKPPKIVRISVTDTYATDSSSDEENEVAAGSSHKRHVTRVKKFVNEISIEPPSSSRSADCVPVDTVLGTKPSRSARKKVGDNGSRTRRFPSKATATVVVGKKFRGVRQRPWGKWAAEIRDPLRRVRLWLGTYDTAEEAAMVYDNAAIQLRGPDALTNFVTPPARCSPLAATSGYISGDESNSNYNINNDGVVNVSSPISVLRFSEEAETQSASSSREIRDTGTEVPEVKEDSCVSENLSDFSEYNSSIDSLFPPTTDICELRSSMRNIFEETSFAAGGFLKDDDFRDMDLDFGFGLSSWNVQDHFQDIGDLFGSDSLIAF

SEQ ID NO: 388 - DNA, 1044 bp, Populus trichocarpa
  POPTR_0003s13610.1
atggatcatccagtcaagtttactgagcatagaaaccaaaccaaactttcagccccatttttgtcaaacccggtccaatactcaaaaccaccaaagattgtacggatatcagtaactgacacatacgcaactgactcttcaagtgacgaagaaaacgaggtttcaagagtctcttctcgtaaacgacatgtgacaagagtcaaaaagtttgtcaatgaaattacgatagagccatcagcaccaccatcaagaaccgctgattgtgtcacaagcgacaccggtttgagggccagaccgtcgaggagtgctaggaagaaggttggcgttgatgtgtctcaggcgagacggttgccggcgacgggggtggtggggaagaagtttagaggggtgaggcaaaggccttgggggaaatgggcggccgagattagagatcctttgagacgtgtacggctgtggctaggtacttacgatactgctgaagaagctgctatggtttatgacaatgcggctattcagttgcgtggagctgacgcgctcactaactttgtcactcctccggcgagatgttcaccggctgcagccacctccgggtacatatccggtgatgagtcaaatagcaaccacaatattaacaatgacaatgttaatgttagctctccaatttcagtgctccggtttagtgaagaagccgagtctcaaagtgtcggttcaagcagagaaacccgaaagaccggaaatgaagtccgggaagtaaaggaggactcctgtgtatcggaaaacttttccgacttttcggagcataattcctctatcgacagtctatttcctccaacaaccgacatttatgaattccggagttcagtgaggggtatttttgaggaaacaacaatttttgctgatggtgggtttttaaaagatgatgattttagggacatggatttggatttcgggttcgggttcgggttcgggttatctagctggaacgttcaagaccattttcaagatattggtgatttgttctggtcggattctcttatagccatt

SEQ ID NO: 389 - protein, 348 aa, Populus trichocarpa
  POPTR_0003s13610.1 polypeptide
MDHPVKFTEHRNQTKLSAPFLSNPVQYSKPPKIVRISVTDTYATDSSSDEENEVSRVSSRKRHVTRVKKFVNEITIEPSAPPSRTADCVTSDTGLRARPSRSARKKVGVDVSQARRLPATGVVGKKFRGVRQRPWGKWAAEIRDPLRRVRLWLGTYDTAEEAAMVYDNAAIQLRGADALTNFVTPPARCSPAAATSGYISGDESNSNHNINNDNVNVSSPISVLRFSEEAESQSVGSSRETRKTGNEVREVKEDSCVSENFSDFSEHNSSIDSLFPPTTDIYEFRSSVRGIFEETTIFADGGFLKDDDFRDMDLDFGFGFGFGLSSWNVQDHFQDIGDLFWSDSLIAI

SEQ ID NO: 390 - DNA, 975 bp, Eucalyptus grandis
  Eucgr.K00321.1
atggacgactgtttcttcaacccagtgaagtacaccgagcaccgaaccgtcacgaggaagctgaccagagccgcgcgcaagagctttccgccggcgcccacccggcgctacgtgcacgagatcagcgtcgagccggcctcgcgcggcggcggcgcgctgcaggcggcctcgatctctcgcaagaggccgagcctcgcggacccgcaagtcccgaggaggccgctgaaggcggcggcgatggaggcggcgacgggctccgggcggaagttccggggtgtgaggcagcgcccttggggcaaatgggcggcggagattcgggacccggcgcgtcgcgtgcggctgtggctgggtacctacgacaccgccgaggaggcagccatggtgtacgacaacgctgcaataaagttgcgcgggcccgacgccctcaccaacttcgcgaccccattgaaagaagcggccgtcacggacgatgtcgacgcggacatcgaagaagtcgccgccgaggacaacatcaacaccgcggcgtgcggctacgactccggcgacgactcgcgcaacctctcatccccgacgtcggtcctccacttccggacgcagtccggggaggaggccgagccggccggaccggccccacaagtcgagccagcggaaccggtacgggaggagcccgggacgtccaagccggcggcggaggaggaggtccaggagtgccagggggagacgggcgagttcgcgcccctggacttgccgttcctggacgacttcttcaacttcgacccgccggaatcgacgctgttcgacgagacgacgatagggacgttctcggaccggctgctggcggaggacttcatgagcgacatcttcgtcgaccggccggaggatttcgggtcgttgtccccgatggacatgtgtcaggcggacgattactttcaagacatcggagatttgttcgcatcggatcctctcgtggcgcct

SEQ ID NO: 391 - protein, 325 aa, Eucalyptus grandis
  Eucgr.K00321.1 polypeptide
MDDCFFNPVKYTEHRTVTRKLTRAARKSFPPAPTRRYVHEISVEPASRGGGALQAASISRKRPSLADPQVPRRPLKAAAMEAATGSGRKFRGVRQRPWGKWAAEIRDPARRVRLWLGTYDTAEEAAMVYDNAAIKLRGPDALTNFATPLKEAAVTDDVDADIEEVAAEDNINTAACGYDSGDDSRNLSSPTSVLHFRTQSGEEAEPAGPAPQVEPAEPVREEPGTSKPAAEEEVQECQGETGEFAPLDLPFLDDFFNFDPPESTLFDETTIGTFSDRLLAEDFMSDIFVDRPEDFGSLSPMDMCQADDYFQDIGDLFASDPLVAP

SEQ ID NO: 392 - DNA, 1068 bp, Brachypodium distachyon
  Bradi2g07357.1
atggaggaggagttttacatgccggtgaagaggacggagcacgtcgaggtgacttccagggtcgtggcggtgtcgtcttcgccggcttcctcggcgaaggcgaaggggaagtaccccaagacggtgagggtcttctgcgaagacaacgacgcgaccgattcgtctagcgacgaggaaggggcgcccgagcgcaggcgggtgaagcgctacgtgcaggagctccgcctggagccggcggtgccggccaaggcgaggagcgccgaagacgcggccccggccccggcggcgccgatgacggcggcgacgacgaaggcgctggtccccgtcaggaagaggaaggccggcgcggacgccggcggctccccgcggttccgcggcgtgcggcggcggccgtggggtaagtacgcggcggagatccgcgatccgtggcggcgggtgcgcgtttggctcggcaccttcgacaccgcggaggaggccgcgagggtctacgactcggcggccatcaagctgcgcgggcccgacgccaccgtcaacttccaggagtccgaggacggcgacatggaggtcccgcccgaggtcgccgaacgcctcccacagccccccgcagccgcggcggggtccaagaacgcctcctcctcggctacctcctacgattcctgcgaggagtcgcacgtggccgcggcgtccccaacctccgtcctccgctgctccttccatccgtccaccttgtctacagtcggcggcgacgacaacacctcgaagaagccgtcggcctccttccgcagcgtcgagaccggcgagtccagcggcgtcttcggctgctcgttccccgacaacagcttcgccggcgagctgcccccgctcttcaccgacttcgacctcctgtccgacttcccggagcccccgatggacttcctctccaacctcccagaggagcacttcccattctccaacgactcctcgccggacttccgcctcgacccgccttcgccggcggcgttgcagcaggcggacgaattcttcgaggacatcaccgacctcttccaaatcgatcccctccccgcaatc

SEQ ID NO: 393 - protein, 356 aa, Brachypodium distachyon
  Bradi2g07357.1 polypeptide
MEEEFYMPVKRTEHVEVTSRVVAVSSSPASSAKAKGKYPKTVRVFCEDNDATDSSSDEEGAPERRRVKRYVQELRLEPAVPAKARSAEDAAPAPAAPMTAATTKALVPVRKRKAGADAGGSPRFRGVRRRPWGKYAAEIRDPWRRVRVWLGTFDTAEEAARVYDSAAIKLRGPDATVNFQESEDGDMEVPPEVAERLPQPPAAAAGSKNASSSATSYDSCEESHVAAASPTSVLRCSFHPSTLSTVGGDDNTSKKPSASFRSVETGESSGVFGCSFPDNSFAGELPPLFTDFDLLSDFPEPPMDFLSNLPEEHFPFSNDSSPDFRLDPPSPAALQQADEFFEDITDLFQIDPLPAI

SEQ ID NO: 394 - DNA, 900 bp, Brachypodium distachyon
  Bradi2g45530.1
atgtcgcggtcgcgcacagtgcgaatcttttgggacgacccggacgtgacggactcgtccggagaggaggaatcttgcggcggcgccaggagggtggcaaggatggtgcgggagctccctccggcgccggcgcctgccttgcttgtgcaggcgggatttacttctgctggtttcccggagcagtgcatcctcggagaagatgatgaccaggcgaggcccgtcggtggcgcatgtactggggcgcggaagaggtctgccaagggcggctccgctgcggcggctggcaccaacaagtttcgcggcgtcaggaggcggccgtggggcaagtacgcggcggagatccgcgacccgtggcgcggcgtgcgcgtctggctcggcactttcgacaccgccgaggaggccgcgcgcgtgtacgactccgccgccatccagctccgtggcgcgagcgcgacgaccaacttctccacctcttccgagggcgccacccaagatccggcggcgaccgggtacgagtccggcgcggagtcctcgcaggcggtgtcgtccccgacctccgtgctccgcaaggtcccgtcgatgtcgtcgctggcggaggacaggggggacgactccgaggcgtaccaaggcgataatggcggctccagcagcctcgctgttctggaggagctcggcgagttcgtgccgttcgaggacgcgccggtctactccagcagcagcttctgggacttcgagccgcaggcgggcttcctctacgcggagccgtcgtcgcctgatgaggcttcatggggggacgcctctgccggcgagccatgggcggcggcgccggtgcaggacaacaatgactacttcttccaggacttgcgcgacctgttcccgctcaacccgcctcccgcgattttc

SEQ ID NO: 395 - protein, 300 aa, Brachypodium distachyon
  Bradi2g45530.1 polypeptide
MSRSRTVRIFWDDPDVTDSSGEEESCGGARRVARMVRELPPAPAPALLVQAGFTSAGFPEQCILGEDDDQARPVGGACTGARKRSAKGGSAAAAGTNKFRGVRRRPWGKYAAEIRDPWRGVRVWLGTFDTAEEAARVYDSAAIQLRGASATTNFSTSSEGATQDPAATGYESGAESSQAVSSPTSVLRKVPSMSSLAEDRGDDSEAYQGDNGGSSSLAVLEELGEFVPFEDAPVYSSSSFWDFEPQAGFLYAEPSSPDEASWGDASAGEPWAAAPVQDNNDYFFQDLRDLFPLNPPPAIF

SEQ ID NO: 396 - protein, 56 aa, Arabidopsis thaliana
  AT4G11140.1 AP2 domain
FRGVRQRPWGKWAAEIRDPSRRVRVWLGTFDTAEEAAIVYDNAAIQLRGPNAELNF

SEQ ID NO: 397 - protein, 56 aa, Arabidopsis thaliana
  AT2G46310.1 AP2 domain
YRGVRQRPWGKFAAEIRDPSSRTRLWLGTFATAEEAAIGYDRAAIRIKGHNAQTNF

SEQ ID NO: 398 - protein, 56 aa, Arabidopsis thaliana
  AT3G61630.1 AP2 domain
YRGVRQRPWGKFAAEIRDPSSRTRIWLGTFVTAEEAAIAYDRAAIHLKGPKALTNF

SEQ ID NO: 399 - protein, 56 aa, Arabidopsis thaliana
  AT4G23750.1 AP2 domain
FRGVRQRPWGKWAAEIRDPLKRVRLWLGTYNTAEEAAMVYDNAAIQLRGPDALTNF

SEQ ID NO: 400 - protein, 56 aa, Arabidopsis thaliana
  AT4G27950.1 AP2 domain
YRGVRQRPWGKWAAEIRDPEQRRRIWLGTFATAEEAAIVYDNAAIKLRGPDALTNF

SEQ ID NO: 401 - protein, 56 aa, Arabidopsis thaliana
  AT5G53290.1 AP2 domain
FRGVRQRPWGKWAAEIRDPEQRRRIWLGTFETAEEAAVVYDNAAIRLRGPDALTNF

SEQ ID NO: 402 - protein, 56 aa, Solanum lycopersicum
  Solyc03g007460.1.1 AP2 domain
FRGVRQRPWGKWAAEIRDPARRVRLWLGTYDTAEEAAMVYDNAAIKLRGPDALTNF

SEQ ID NO: 403 - protein, 56 aa, Solanum lycopersicum; identical to SEQ ID NO: 402
  Solyc06g051840.1.1 AP2 domain

SEQ ID NO: 404 - protein, 56 aa, Glycine max
  Glyma04g41740.1 AP2 domain
FRGVRQRPWGKWAAEIRDPARRVRLWLGTYDTAEEAAMVYDNAAIRLRGPDALTNF

SEQ ID NO: 405 - protein, 56 aa, Glycine max; identical to SEQ ID NO: 404
  Glyma06g13040.1 AP2 domain

SEQ ID NO: 406 - protein, 56 aa, Glycine max
  Glyma13g08490.1 AP2 domain
FRGVRQRPWGKWAAEIRDPVQRVRIWLGTFETAEEAALCYDNAAIMLRGPDALTNF

SEQ ID NO: 407 - protein, 56 aa, Glycine max
  Glyma14g29040.1 AP2 domain
FRGVRQRPWGKWAAEIRDPVQRVRIWLGTFKTAEEAALCYDNAAITLRGPDALTNF

SEQ ID NO: 408 - protein, 56 aa, Glycine max
  Glyma05g37120.1 AP2 domain
FRGVRQRPWGKWAAEIRDPLRRVRLWLGTYDTAEEAAIVYDNAAIQLRGADALTNF

SEQ ID NO: 409 - protein, 56 aa, Glycine max
  Glyma08g02460.1 AP2 domain
FRGVRQRPWGKWAAEIRDPSRRVRLWLGTYDTAEEAAIVYDNAAIQLRGADALTNF

SEQ ID NO: 410 - protein, 56 aa, Glycine max
  Glyma01g43350.1 AP2 domain
FRGVRQRPWGKWAAEIRDPSRRVRLWLGTYDTAEEAALVYDNAAIRLRGPHALTNF

SEQ ID NO: 411 - protein, 56 aa, Solanum lycopersicum
  Solyc08g081960.1.1 AP2 domain
FRGVRQRPWGKWAAEIRDPLRRVRLWLGTYDTAEEAAMVYDHAAIQLRGPDALTNF

SEQ ID NO: 412 - protein, 56 aa, Oryza sativa
  LOC_Os01g12440.1 AP2 domain
FRGVRRRPWGKYAAEIRDPWRRVRVWLGTFDTAEEAAKVYDTAAIQLRGRDATTNF

SEQ ID NO: 413 - protein, 56 aa, Zea mays
  GRMZM2G044077_T01 AP2 domain
FRGVRRRPWGKYAAEIRDPWRRVRVWLGTFDTAEEAAKVYDSAAVQLRGRDATTNF

SEQ ID NO: 414 - protein, 56 aa, Zea mays
  GRMZM2G142179_T01 AP2 domain
FRGVRRRPWGKYAAEIRDPWRRVRVWLGTFDTAEEAAKVYDSAAIQLRGADATTNF

SEQ ID NO: 415 - protein, 56 aa, Setaria italica
  Si002247m AP2 domain
FRGVRRRPWGKYAAEIRDPWRRVRVWLGTFDTAEEAAKVYDSAAIQLRGPDATTNF

SEQ ID NO: 416 - protein, 56 aa, Oryza sativa
  LOC_Os01g46870.1 AP2 domain
FRGVRRRPWGKFAAEIRDPWRGVRVWLGTFDTAEEAARVYDNAAIQLRGPSATTNF

SEQ ID NO: 417 - protein, 56 aa, Zea mays
  GRMZM2G151542_T01 AP2 domain
FRGVRRRPWGKFAAEIRDPWRGVRVWLGTFDTAEEAARVYDAAAVQLRGANATTNF

SEQ ID NO: 418 - protein, 56 aa, Zea mays
  GRMZM2G160971_T01 AP2 domain
FRGVRRRPWGKFAAEIRDPWRGVRVWLGTFDTAEEAARVYDTAAIQLRGANATTNF

SEQ ID NO: 419 - protein, 56 aa, Oryza sativa
  Os06g06540.1 AP2 domain
FRGVRKRPWGKYGAEIRVSQQSARVWLGTFDTAEEAARVYDHAALRLRGPSATTNF

SEQ ID NO: 420 - protein, 56 aa, Zea mays
  GRMZM2G328197_T01 AP2 domain
YRGVRRRPWGKYAAEIRDPHKGERLWLGTFDTAEEAAREYDSAARRLRGPSATTNF

SEQ ID NO: 421 - protein, 56 aa, Zea mays
  GRMZM2G429378_T01 AP2 domain
YRGVRRRPWGRYAAEIRDPHKGERLWLGTFDTAEEAARRYDSETRRLRGPSAITNF

SEQ ID NO: 422 - protein, 56 aa, Setaria italica
  Si008428m AP2 domain
YRGVRRRPWGKYAAEIRDPHKNARVWLGTFDTAEEAARMYDSEARRLRGPSATTNF

SEQ ID NO: 423 - protein, 56 aa, Zea mays
  GRMZM2G009598_T01 AP2 domain
FRGVRRRPWGRWAAEIREPHNRRRLWLGTFDTAEEAANAYDAANIRFRGVSATTNF

SEQ ID NO: 424 - protein, 56 aa, Setaria italica
  Si037209m AP2 domain
FRGVRRRAWGRWAAEIRDPHGSRRIWLGTFNSAEEAAAAYDVANIRFRGASAHTNF

SEQ ID NO: 425 - protein, 56 aa, Citrus clementina
  clementine0.9_017304m AP2 domain
YRGVRMRPWGKWAAEIRDPFQRTRVWLGTFETAEEAALVYDQAAIRLKGPHAQTNF

SEQ ID NO: 426 - protein, 56 aa, Eucalyptus grandis
  Eucgr.E00834.1 AP2 domain
FRGVRQRPWGKWAAEIRDPKKGTRVWLGTFGTAEEAALVYDNAAIQLRGPDALTNF

SEQ ID NO: 427 - protein, 56 aa, Populus trichocarpa
  POPTR_0002s16900.1 AP2 domain
YRGVRQRPWGRWAAEIRDPYRRTRLWLGTYDTAEEAAMVYDQAAIRIKGPDAQTNF

SEQ ID NO: 428 - protein, 56 aa, Populus trichocarpa
  POPTR_0014s09020.1 AP2 domain
YRGVRQRPWGRWAAEIRDPYRRTRVWLGTYDTAEEAAMVYDQAAIRIKGPDAQTNF

SEQ ID NO: 429 - protein, 56 aa, Citrus clementina
  clementine0.9_013577m AP2 domain
FRGVRQRPWGKWAAEIRDPARRVRLWLGTYDTAEEAARVYDNAAIKLRGPDALTNF

SEQ ID NO: 430 - protein, 56 aa, Eucalyptus grandis
  Eucgr.A02669.1 AP2 domain
FRGVRQRPWGKWAAEIRDPTRRVRLWLGTYDTAEEAAMVYDNAALKLRGPDAQTNF

SEQ ID NO: 431 - protein, 56 aa, Populus trichocarpa; identical to SEQ ID NO: 429
  POPTR_0012s01260.1 AP2 domain

SEQ ID NO: 432 - protein, 56 aa, Populus trichocarpa
  POPTR_0015s06070.1 AP2 domain
FRGVRQRPWGKWAAEIRDPARRQRLWLGTYDTAEEAARVYDNAAIKLRGPDALTNF

SEQ ID NO: 433 - protein, 56 aa, Citrus clementina
  clementine0.9_015380m AP2 domain
FRGVRQRPWGKWAAEIRDPLRRVRLWLGTYDTAEEAAMVYDNAAIQLRGPDALTNF

SEQ ID NO: 434 - protein, 56 aa, Eucalyptus grandis
  Eucgr.D01775.1 AP2 domain
FRGVRRRPWGKWAAEIRDPLRRVRLWLGTYDTAEEAAMVYDQAAIQLRGPDALTNF

SEQ ID NO: 435 - protein, 56 aa, Glycine max
  Glyma11g02140.1 AP2 domain
FRGVRQRPWGKWAAEIRDPARRVRLWLGTYDTAEEAALVYDNAAIKLRGPHALTNF

SEQ ID NO: 436 - protein, 56 aa, Populus trichocarpa; identical to SEQ ID NO: 433
  POPTR_0001s10300.1 AP2 domain

SEQ ID NO: 437 - protein, 56 aa, Populus trichocarpa
  POPTR_0003s13610.1 AP2 domain
FRGVRQRPWGKWAAEIRDPLRRVRLWLGTYDTAEEAAMVYDNAAIQLRGADALTNF

SEQ ID NO: 438 - protein, 56 aa, Eucalyptus grandis; identical to SEQ ID NO: 402
  Eucgr.K00321.1 AP2 domain

SEQ ID NO: 439 - protein, 56 aa, Brachypodium distachyon
  Bradi2g07357.1 AP2 domain
FRGVRRRPWGKYAAEIRDPWRRVRVWLGTFDTAEEAARVYDSAAIKLRGPDATVNF

SEQ ID NO: 440 - protein, 56 aa, Brachypodium distachyon
  Bradi2g45530.1 AP2 domain
FRGVRRRPWGKYAAEIRDPWRGVRVWLGTFDTAEEAARVYDSAAIQLRGASATTNF

SEQ ID NO: 441 - protein, 56 aa, Arabidopsis thaliana
  misc_feature (1)..(1): Xaa can be Phe or Tyr
  misc_feature (4)..(4): Xaa can be Ile, Val, Leu, or Met
  misc_feature (6)..(6): Xaa can be any naturally occurring amino acid
  misc_feature (8)..(8): Xaa can be Pro or Ala
  misc_feature (11)..(11): Xaa can be Arg or Lys
  misc_feature (12)..(12): Xaa can be Trp, Phe or Tyr
  misc_feature (13)..(13): Xaa can be Ala or Gly
  misc_feature (18)..(23): Xaa can be any naturally occurring amino acid
  misc_feature (25)..(25): Xaa can be Ile, Val, Leu, or Met
  misc_feature (30)..(30): Xaa can be Phe or Tyr
  misc_feature (31)..(31): Xaa can be any naturally occurring amino acid
  misc_feature (32)..(32): Xaa can be Thr or Ser
  misc_feature (38)..(39): Xaa can be any naturally occurring amino acid
  misc_feature (42)..(47): Xaa can be any naturally occurring amino acid
  misc_feature (48)..(48): Xaa can be Arg or Lys
  misc_feature (50)..(51): Xaa can be any naturally occurring amino acid
  misc_feature (53)..(54): Xaa can be any naturally occurring amino acid
  AP2 domain consensus sequence of the CRF1 clade
XRGXRXRXWGXXXAEIRXXXXXXRXWLGTXXXAEEAAXXYDXXXXXXXGXXAXXNF

SEQ ID NO: 442 - protein, 17 aa, Arabidopsis thaliana
  misc_feature (1)..(1): Xaa can be Ile, Val, Leu, or Met
  misc_feature (2)..(2): Xaa can be any naturally occurring amino acid
  misc_feature (3)..(3): Xaa can be Ile, Val, Leu, or Met
  misc_feature (4)..(6): Xaa can be any naturally occurring amino acid
  misc_feature (8)..(10): Xaa can be any naturally occurring amino acid
  misc_feature (12)..(12): Xaa can be Asp or Glu
  misc_feature (15)..(15): Xaa can be Gly or Ser
  misc_feature (16)..(16): Xaa can be any naturally occurring amino acid
  misc_feature (17)..(17): Xaa can be Asp or Glu
  small domain consensus sequence of the CRF1 clade
XXXXXXDXXXTXSSXXX

SEQ ID NO: 443 - DNA, 786 bp, Arabidopsis thaliana
  AT1G72360.2
atgtgcggaggagctgtaatttccgattacatagcgccggagaagattgcgagatcatctggaaagtcttcctggagaagtaatggcgtctttgactgctcaatctacgatttcgatggaaatttcgatgaattagagtccgatgagccatttgtcttctcctctactcacaaacatcatgcttcaggctcagcatcagatgggaagaagaaacagagcagtcggtacaaaggaatcagaagaaggccttggggaagatgggcggctgagatacgtgatccaatcaaaggagttcgagtttggctcgggactttcaacacagctgaagaagctgcaagagcttatgatcttgaagctaagagaatccgtggagccaaagctaagctcaatttccctaacgaatcctctggaaagaggaaagccaaggctaagactgtgcaacaggtagaggagaatcatgaggctgatcttgatgtggcggtggtaagctcagcgcctagtagtagctgtcttgatttcttgtgggaggagaataatccggacacgcttctgattgatacacaatggctcgaagatatcatcatgggcgatgcgaataagaaacatgaacctaatgatagtgaagaagccaacaacgttgatgcttctctgctttctgaagagcttcttgcttttgagaaccagaccgaatatttctcgcagatgccttttacggagggaaactgtgattcctcaacgtctctgagtagtctctttgatggaggcaatgacatgggtctatggtcc

SEQ ID NO: 444 - protein, 262 aa, Arabidopsis thaliana
  AT1G72360.2 polypeptide
MCGGAVISDYIAPEKIARSSGKSSWRSNGVFDCSIYDFDGNFDELESDEPFVFSSTHKHHASGSASDGKKKQSSRYKGIRRRPWGRWAAEIRDPIKGVRVWLGTFNTAEEAARAYDLEAKRIRGAKAKLNFPNESSGKRKAKAKTVQQVEENHEADLDVAVVSSAPSSSCLDFLWEENNPDTLLIDTQWLEDIIMGDANKKHEPNDSEEANNVDASLLSEELLAFENQTEYFSQMPFTEGNCDSSTSLSSLFDGGNDMGLWS

SEQ ID NO: 445 - DNA, 513 bp, Arabidopsis thaliana
  AT2G47520.1
atgtgtgggggagctatcatttctgatttcatctggtcgaaatctgagtcagaaccgagtcaactcggctctgttagcagcaggaagaagcgtaaacccgtctcagtgagtgaagaaagagatgggaaacgagagaggaagaatctgtacagagggataaggcagaggccatggggcaaatgggcagcggagattcgtgacccgagcaaaggtgtacgtgtctggcttggcacattcaaaaccgccgacgaagctgctcgagcctacgacgttgctgccatcaaaatccgtggccggaaagccaaactgaatttcccaaacactcaagtagaagaagaagccgatactaaaccaggggggaatcaaaatgagctgatttcggaaaaccaagtagagagcttatcggaggacctgatggcattggaggattacatgagattctatcagattccggttgccgacgaccaatcggcgaccgatattggaaatttatggagctatcaagactccaat

SEQ ID NO: 446 - protein, 171 aa, Arabidopsis thaliana
  AT2G47520.1 polypeptide
MCGGAIISDFIWSKSESEPSQLGSVSSRKKRKPVSVSEERDGKRERKNLYRGIRQRPWGKWAAEIRDPSKGVRVWLGTFKTADEAARAYDVAAIKIRGRKAKLNFPNTQVEEEADTKPGGNQNELISENQVESLSEDLMALEDYMRFYQIPVADDQSATDIGNLWSYQDSN

SEQ ID NO: 447 - DNA, 900 bp, Glycine max
  Glyma02g01960.1
atgtgtggcggtgccatcatcgctgacttcataccccgccgtggaggccgccgcctcacggcctccgagctctggccaaactccttcgccaaagacgatgactttgacttggattactcccacatcgctacccaacaaccctccactctcaaaaggtcccaacctcccaaagttagcgagcaggttgagaataagccggtgaagaggcagaggaagaatctctacagagggattcggcagcgtccgtggggcaaatgggccgcggagattcgcgatcctagaaaaggggttcgtgtctggttgggcacctttaacaccgcagaagaagccgcgagagcctacgatcgtgaagctcgaaaaatccgaggcaaaaaggctaaggtgaatttccccaacgaggacgacgaatattccattcaagctcgtaatccaattccaccccttcctttcgctccacaacaccctcccctgtaccagcaacagtaccgttgcgatctcaacaatgcccctaaaaatctcaactttgagttcggttacgacctgaaccacgcggaggcgttcccatcccgcgtggacgccgtcaacgctgactcggtggttgtctccgttgatgaaaattcggggtcagcgtcgggttcagagggtgcttattcgacaacggagttcatggggtccgttcagaacgggaacggttatttgggtggcacggtaatggagaagaaggagaaagagacagaggttattgaagctgaagaagaaaagaacaaagtgctggagctttctgaggagctgatggcgtacgaaaattacatgaagttttatcagattccgtactatgatggacaatccacgacgaataatgttcaggaaagcttggttggggatctctggagtttcgat

SEQ ID NO: 448 - protein, 300 aa, Glycine max
  Glyma02g01960.1 polypeptide
MCGGAIIADFIPRRGGRRLTASELWPNSFAKDDDFDLDYSHIATQQPSTLKRSQPPKVSEQVENKPVKRQRKNLYRGIRQRPWGKWAAEIRDPRKGVRVWLGTFNTAEEAARAYDREARKIRGKKAKVNFPNEDDEYSIQARNPIPPLPFAPQHPPLYQQQYRCDLNNAPKNLNFEFGYDLNHAEAFPSRVDAVNADSVVVSVDENSGSASGSEGAYSTTEFMGSVQNGNGYLGGTVMEKKEKETEVIEAEEEKNKVLELSEELMAYENYMKFYQIPYYDGQSTTNNVQESLVGDLWSFD

SEQ ID NO: 449 - DNA, 912 bp, Glycine max
  Glyma10g02080.1
atgtgtggcggtgccatcatagccgacttcattccccgccgtggaggccgccgcctcacggcctccgagctctggcctaactccttcggcaaagacggtgactttgacttcgattactcccacatcgccgatcaacaacgttccactctcaaaatgtccccacctcccaaagctagcgagcaagtggagaataagccggtgaagaggcagaggaagaatctctacagagggattcggcaacgtccgtggggaaaatgggccgcggagattcgcgatccaagaaaaggggttcgtgtctggttgggcaccttcaacactgcagaagaagccgcaagagcctatgatcgtgaagctcgaaaaatccgcggcaaaaaggccaaggtgaatttccccaacgaggacgacgaatattccattcaagcacgtcatccgattccaccccttcctttcacaccacaaacacaaaaccctcccctgtaccagcaacagtaccgttgcgatctcaacattgcccctaaaaatctcaactttgagttcgggtacgacctgaaccacgcgggggcatttccgtcccacgtggacgccgtcaacgctgactcggtggttgtctccggcgatgaaaattcagggttagcgtcgggttcagagggtgcttattcgacaacggagtttatgggatccagtcaaaacgggaacgggtatctgggtgttaccgcaatggagaagaatgagaaagagacagaggttattgaagctcaagaagaaaagaacaaagtgcaggagctttctgaggagctgatggcgtacgagaattacatgaagttttatcagattccgtactatgatggacaatccacggctccaccgaataatgttcaggaaagcttggtcggggatctctggagttttgat

SEQ ID NO: 450 - protein, 304 aa, Glycine max
  Glyma10g02080.1 polypeptide
MCGGAIIADFIPRRGGRRLTASELWPNSFGKDGDFDFDYSHIADQQRSTLKMSPPPKASEQVENKPVKRQRKNLYRGIRQRPWGKWAAEIRDPRKGVRVWLGTFNTAEEAARAYDREARKIRGKKAKVNFPNEDDEYSIQARHPIPPLPFTPQTQNPPLYQQQYRCDLNIAPKNLNFEFGYDLNHAGAFPSHVDAVNADSVVVSGDENSGLASGSEGAYSTTEFMGSSQNGNGYLGVTAMEKNEKETEVIEAQEEKNKVQELSEELMAYENYMKFYQIPYYDGQSTAPPNNVQESLVGDLWSFD

SEQ ID NO: 451 - DNA, 582 bp, Glycine max
  Glyma19g40070.1
atgtgtggcggagcaatcatcgcagatttcatacctcggcagcgtccccgcaccctcacagcctccgaactctggcccaagcgcagcgaacctcaacctcaacctcctcctcctccagttaagaggcagaggaaaaacctctacagagggatcaggcagcggccctggggcaaatgggccgcggagattcgcgatccacgtaaaggagttcgtgtctggcttggcaccttcaacaccgccgaagaagccgccagagcctacgacaaagaagcccgaaaaatccgcggcaagaaagccaaagtcaatttccccaacgaggacgaccctctgccgcaatacggatcttgcaagagcctcaacttggagttcggttacgatctcaaccaaacagggcttttcccttcttctaacgctgatgagaattgcgggtcccacgtggcttactccgttacggaagccaacaacaaagtagagaagctttccgaggagcttatggcgtacgagaatttaatgaggttttatcagattccggaaaacgtcgttggggatttgtgggcctttcctgacacctctccacctctc

SEQ ID NO: 452 - protein, 194 aa, Glycine max
  Glyma19g40070.1 polypeptide
MCGGAIIADFIPRQRPRTLTASELWPKRSEPQPQPPPPPVKRQRKNLYRGIRQRPWGKWAAEIRDPRKGVRVWLGTFNTAEEAARAYDKEARKIRGKKAKVNFPNEDDPLPQYGSCKSLNLEFGYDLNQTGLFPSSNADENCGSHVAYSVTEANNKVEKLSEELMAYENLMRFYQIPENVVGDLWAFPDTSPPL

SEQ ID NO: 453 - DNA, 744 bp, Arabidopsis thaliana
  AT3G16770.1
atgtgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgag

SEQ ID NO: 454 - protein, 248 aa, Arabidopsis thaliana
  AT3G16770.1 polypeptide
MCGGAIISDYAPLVTKAKGRKLTAEELWSELDASAADDFWGFYSTSKLHPTNQVNVKEEAVKKEQATEPGKRRKRKNVYRGIRKRPWGKWAAEIRDPRKGVRVWLGTFNTAEEAAMAYDVAAKQIRGDKAKLNFPDLHHPPPPNYTPPPSSPRSTDQPPAKKVCVVSQSESELSQPSFPVECIGFGNGDEFQNLSYGFEPDYDLKQQISSLESFLELDGNTAEQPSQLDESVSEVDMWMLDDVIASYE

SEQ ID NO: 455 - DNA, 711 bp, Glycine max
  Glyma09g04630.1
atgtgtggaggtgctatcatctcagacttcattggtgtgaagcgtggccgcaacctcgccgcgcaggaactatggtctgagcttgaccctttctctgacttccttggcttcgataccaccaattccaaaaaccaaccacccctgcagaaaattccagacaaaaaagtggtgtcatcatgtgagaagaagaagaaaagcgtggtgggtgcagaaaagaagaagagtgatagtgggcgagctcgtaaaaacgtgtacagaggaatcaggcaaaggccatggggcaagtgggccgcggagataagggacccacacaagggtgttcgtgtctggctcggcaccttccccaccgccgaagaagccgcccaagcctacgacgacgccgccatacgcatccgcggcgacaaggccaagctcaacttcccggccaccaccatttccgccgccgccgctccgccaccttccaaaaagcaacgctgcctcagccctgacatcatcactgaagaaagcagcagcagcagctcacattccaccactggatccaccggcgaaagcggcggaggaaacgacgaactcgacctgaaacaaattgaatggtttctaggtttggagaatgagctgcctgttagcaacaacattggtgctgagtgggacaacatggatgacctgtggatgctggacgacgtcgttgtgcccaaccgtcacttaatttac

SEQ ID NO: 456 - protein, 237 aa, Glycine max
  Glyma09g04630.1 polypeptide
MCGGAIISDFIGVKRGRNLAAQELWSELDPFSDFLGFDTTNSKNQPPLQKIPDKKVVSSCEKKKKSVVGAEKKKSDSGRARKNVYRGIRQRPWGKWAAEIRDPHKGVRVWLGTFPTAEEAAQAYDDAAIRIRGDKAKLNFPATTISAAAAPPPSKKQRCLSPDIITEESSSSSSHSTTGSTGESGGGNDELDLKQIEWFLGLENELPVSNNIGAEWDNMDDLWMLDDVVVPNRHLIY

SEQ ID NO: 457 - DNA, 669 bp, Glycine max
  Glyma15g16260.1
atgtgtggaggtgctatcatctcagacttcattggtgtgaagcgtggccgcaacctcgccgcgcaggaactgtggtccgagcttgaccctttctctgacctccttggcttcgataccaccaccaccaccaccaaccaaccaccccttccagacaaaaaagtggtgtcatcatgtgagaagaagaagaagaaaagtgtgagtgcagaaaagaagagtggtgggcgagctcggaagaacgtgtacagaggaatcaggcaaaggccgtggggcaagtgggccgcggaaataagggacccacataagggcgtccgcgtctggctcggcaccttccccaccgccgaggaagccgcccgagcctacgacgacgccgccaagcgcatccgcggcgacaaggccaagctcaacttcccggccaccgctccgccaccctccaaaaaacaacgctgcctcagccctgacaccaccaccgaacaaagcagcagctcacaatccaccactggatccaccggatcgccgccttccgccgccttccacggcggaggagatgaactcgacctgaaacaacttgaacggtttctagggttggacaacatgggtgctgagtgggacaacatggatgacctgtggatgctggacgacgtcgttgtgcccaaccgtcacttaatttac

SEQ ID NO: 458 - protein, 223 aa, Glycine max
  Glyma15g16260.1 polypeptide
MCGGAIISDFIGVKRGRNLAAQELWSELDPFSDLLGFDTTTTTTNQPPLPDKKVVSSCEKKKKKSVSAEKKSGGRARKNVYRGIRQRPWGKWAAEIRDPHKGVRVWLGTFPTAEEAARAYDDAAKRIRGDKAKLNFPATAPPPSKKQRCLSPDTTTEQSSSSQSTTGSTGSPPSAAFHGGGDELDLKQLERFLGLDNMGAEWDNMDDLWMLDDVVVPNRHLIY

SEQ ID NO: 459 - DNA, 1026 bp, Oryza sativa
  LOC_Os07g42510.1
atgtgtggaggatccattctcggcgaccttcacttgccggtgcggcggacagtgaacgccggtgacctgtggggagacgccggcaagggtagagatggtggcgacggcttgaagaagaggaaggggagttcttgggatttcgatgttgattgcgatgatgatgatgatgatgactttgaggctgattttgaggagtttgaggatgactatggcgatgatgatgatgtgggtttcggggacgacgaccaagaatccgacatgaacggtctcaagctcgccggattcagcaccacgaagctcggcctcggcggcagcaggaagaggaagacgcgataccgagggatccggcagcggccatgggggaaatgggcggcggagatcagggacccccgcaagggcgtccgcgtctggctcggcacgttcggcaccgccgaggaggccgccatggcgtacgacgtcgaggcacgccgcatccgcggcaagaaagccaaggtcaacttccccgacgccgccgccgccgccccgaagcggccacggcgttcttcggcgaagcattcgccgcagcagcagaaggccaggtcgtcgtcgtcgtcgccggcgagcctgaacgccagcgacgccgtgtccaagtccaacaacaaccgcgtcagctcggctgggagcagcaccgacgccaccgccgccgccatcgccatcgacgacggcgtcaagctcgagctgctctcggagacggatccttctccgcccatggccgccgccgccgccgcgtggctcgacgcgttcgagctgaacgatcttgacggatcaagatgcaaggacaacgcattcgatcaccagattcacaaggtagaagcggctgtcgctgatgaattcgcgttctacgacgatccgagctacatgcagctgggttaccagctcgatcagggcaactcgtacgagaacatcgacgcgctcttcggcggcgaggccgtcaacattggtggactctggagcttcgacgacatgccaatggagttcagagcttat

SEQ ID NO: 460 - protein, 342 aa, Oryza sativa
  LOC_Os07g42510.1 polypeptide
MCGGSILGDLHLPVRRTVNAGDLWGDAGKGRDGGDGLKKRKGSSWDFDVDCDDDDDDDFEADFEEFEDDYGDDDDVGFGDDDQESDMNGLKLAGFSTTKLGLGGSRKRKTRYRGIRQRPWGKWAAEIRDPRKGVRVWLGTFGTAEEAAMAYDVEARRIRGKKAKVNFPDAAAAAPKRPRRSSAKHSPQQQKARSSSSSPASLNASDAVSKSNNNRVSSAGSSTDATAAAIAIDDGVKLELLSETDPSPPMAAAAAAWLDAFELNDLDGSRCKDNAFDHQIHKVEAAVADEFAFYDDPSYMQLGYQLDQGNSYENIDALFGGEAVNIGGLWSFDDMPMEFRAY

SEQ ID NO: 461 - DNA, 978 bp, Setaria italica
  Si030506m
atgtgtggaggggccattctcagtgatctctattcaccagtgaggcgcacggtcactgctggtgacctatgggcagagagtggtagcagaaggagtggaaagaaccagaaaaggagttcttgggagtttgatgaagccgatgacgacgactttgaggctgattttgaggatttcgaggattgcagtagcgtggaggaggtggattttggacatgaggaaaaagattttcaaataaacagttccattttcatgaaattcaacgaccatactgccaaagtcgcccgcaggaagcgaaagacccagtaccgggggatccggcggcgcccttggggcaaatgggcagctgaaatcagagacccatgcaagggcgtccgagtctggcttggcacctacaacaccgctgaggaggccgcaagagcatacgacgtggcagcccgacgcatacgcggcaagaaagccaaggtgaacttccctgacaccatcacagcgtctgccaaacggcttccaggacgtgtgcctcgaccggcaaagaaggttatgtcacaagagagcctgaagttcagcagcgcctctgaacatgccatctcagcaggcagcagtactgatgccacagtcgtcaagattgagttgtcagagtcagactctccactaccaatgtccagcgcatggcttgatgcgttcgagctgaatcaacttgatggatcgaagtaccttgaagctggtgggaaagaaacaactgaagaaactgatcatgaaaatggggtgacggcagatatggtttttggcaatggcgaagtgtggcttgcggatgaatttgcgtattatgagccttacccgaactttatgcagttaccttaccttgaaggcaactcgtatgaaaacattgacgctcttttcaacggtgaggtggctcaggatggcgtgaacatcggaggtctctggagtttcgacgatgtaccaatggacagtggtgtttac

SEQ ID NO: 462 - protein, 326 aa, Setaria italica
  Si030506m polypeptide
MCGGAILSDLYSPVRRTVTAGDLWAESGSRRSGKNQKRSSWEFDEADDDDFEADFEDFEDCSSVEEVDFGHEEKDFQINSSIFMKFNDHTAKVARRKRKTQYRGIRRRPWGKWAAEIRDPCKGVRVWLGTYNTAEEAARAYDVAARRIRGKKAKVNFPDTITASAKRLPGRVPRPAKKVMSQESLKFSSASEHAISAGSSTDATVVKIELSESDSPLPMSSAWLDAFELNQLDGSKYLEAGGKETTEETDHENGVTADMVFGNGEVWLADEFAYYEPYPNFMQLPYLEGNSYENIDALFNGEVAQDGVNIGGLWSFDDVPMDSGVY

SEQ ID NO: 463 - DNA, 978 bp, Setaria italica; identical to SEQ ID NO: 461
  Si030514m

SEQ ID NO: 464 - protein, 326 aa, Setaria italica; identical to SEQ ID NO: 462
  Si030514m polypeptide

SEQ ID NO: 465 - DNA, 1002 bp, Citrus clementina
  clementine0.9_015288m
atgtgtggcggttctatcttaggagacttctttcctcgccacggcggcagccgcgtcaccgcttccgacctctggcccaactcacccttcgctgctactaaacaactccctcacaactttgaatctactccgttctccgatgaacaccagtcactggccaaaatcaaacgccctcaacccccttcatatctaaactcctgttcagcttcaggtgatgagaaaaagcccaagaggcagaggaagaatctctacaggggaataaggcaacgcccctggggcaaatgggcagctgagattcgtgacccaaggaaaggagttcgagtctggctcggcacattcaacactgccgaagaagcagctcgagcctatgacaaagaagcccgcaagattcgcggcaagaaagccaaagtcaacttccccaacgaagaggacgtcttcaccgtcacccctgctgctgccgcccatgcttaccatcatcatcagcataatcataatcccactcccagtccccttccttctctttcccaagaagatctttttagtcgtaataactcatctataagtagtgttggttttgacttgtatggttatgatctgaacccccagattgttacttctggtggtgacgagaattccgggactggttctggttctgtttcagaaggtgggtacgattccacagaacttatgctgaattgcaaccagaatgtcaatgatggttcgtttgctcaaatgaaggtgaaagccgaagaacaagaagaagaagaaaagcgaaaagctgaagaggaagagaacgaagtgcgaaagctgtctgaggagcttatggcgtacgagaatttcatgaagttctatcagcttccgtatctcgatgggcaatcaccagtgtctaataataataataataataataatattaatattgttcacgaaggtgttgtcggtaatctttggagctttgatgatgttactgttgcccctgcccctgcgaactccaaggctctg

SEQ ID NO: 466 - protein, 334 aa, Citrus clementina
  clementine0.9_015288m polypeptide
MCGGSILGDFFPRHGGSRVTASDLWPNSPFAATKQLPHNFESTPFSDEHQSLAKIKRPQPPSYLNSCSASGDEKKPKRQRKNLYRGIRQRPWGKWAAEIRDPRKGVRVWLGTFNTAEEAARAYDKEARKIRGKKAKVNFPNEEDVFTVTPAAAAHAYHHHQHNHNPTPSPLPSLSQEDLFSRNNSSISSVGFDLYGYDLNPQIVTSGGDENSGTGSGSVSEGGYDSTELMLNCNQNVNDGSFAQMKVKAEEQEEEEKRKAEEEENEVRKLSEELMAYENFMKFYQLPYLDGQSPVSNNNNNNNNINIVHEGVVGNLWSFDDVTVAPAPANSKAL

SEQ ID NO: 467 - DNA, 939 bp, Populus trichocarpa
  POPTR_0002s20270.1
atgtgtggcggtgctattttagctgatatcatccctcgtaaccgcggccgccgcgaagcagcttcacagttctggccaaactcatgcttcgataaactcggtccctttgagtcctgtctgagccaacctagcaatcaggagtcatttactctcaaacgaccccaaccccaaccccaacccgcttcaggggatcatgagcaaatggagaagcccaatgccaagaggcagaggaagaatctatacagaggtataaggcaacgaccttggggtaaatgggcagctgagattcgtgacccaagaaaaggagtccgtgtttggctcggtaccttcaatactgctgaggaagcagctcgagcctacgacagagaggctcgcataatccgcggcaagaaagccaaagtcaattttcctaacgaagatgaacattactcctcctctcaaaattcaaataccaagcctcctatgtaccaaacccccacttgtcatttctcaaaaggttatgattttgggtacggttctggtatgaatcaggttgaagcctactcttcaaatggttttaatggccagccaattgtcgcttccggggaggatgattctgggtccgcttcagaggagggaacaagactggtgggctgtaatcagaacgtgaagagtaatatttatatgggtcaagtgaagctggaagtggaggagaagctagagaaggtgaagaataaggaggtggtggtggtggatttgggaactggagaggaagaaaacgaggtacagaaactgaccgaggagttaattgcgtatgagaattacatgaagttttatcagattccctatctggacgggcaatccatggcaccaaatggttccacacaggaaaaccttgtggctaatctttggaactttgatgatgtttgtgtagctcctcctgtcacctcggcacctctg

SEQ ID NO: 468 - protein, 313 aa, Populus trichocarpa
  POPTR_0002s20270.1 polypeptide
MCGGAILADIIPRNRGRREAASQFWPNSCFDKLGPFESCLSQPSNQESFTLKRPQPQPQPASGDHEQMEKPNAKRQRKNLYRGIRQRPWGKWAAEIRDPRKGVRVWLGTFNTAEEAARAYDREARIIRGKKAKVNFPNEDEHYSSSQNSNTKPPMYQTPTCHFSKGYDFGYGSGMNQVEAYSSNGFNGQPIVASGEDDSGSASEEGTRLVGCNQNVKSNIYMGQVKLEVEEKLEKVKNKEVVVVDLGTGEEENEVQKLTEELIAYENYMKFYQIPYLDGQSMAPNGSTQENLVANLWNFDDVCVAPPVTSAPL

SEQ ID NO: 469 - DNA, 927 bp, Populus trichocarpa
  POPTR_0014s12090.1
atgtgtggcggtgctattttggctggcctcatccctcaccgtggccaccgcgtcgcggcttctgagttctggcccaactcatccttcaataaacccagtcccttcgacacgtatccgagtcctctccgcaatcaggagccattcactctcaaacgaccccagcccacttcaggggatcatgaacaagtggagaagccgaatgccaagaggcagaggaagaatctatacagaggtataaggcaacgaccttggggtaaatgggcagctgagattcgtgacccaagaaaaggagtccgcgtttggctcggtacatttaacacggctgaggaagcagctcgagcctacgacagagaggctcgcaagattcgcggcaagaaagccaaagtcaattttcctaacgaagatgaccattactacacgtcccaaaactcgaacaccaagcctttcctgtaccaagcccccacttgtcatttctcaaaaggttatgattctgggaacgtttatgatgcatatcagatcgaaaccttccattcaaatggtttaattaacgaaccaattgttagttctggggaggatgattctaggtcaggttcagaggaggtgacaggactgctgggctgtaatcagaatgtggagagcaataattatatgggtcaagtaaaggtggaagaggagaaactggaggagaagaaagtgatgaacaaggaggtgatggtggtggatttggaaactggggaggaagaaagcgaggtgcagaagctgactgaggagttaatggcgtatgaaaatttcatgaagttttatcagattccgtatctggatgggcaatcaacggcaccaaatgggacaacccaggaaagccttgtgggtaatctttggagcttttttgatgatggtgttgatgctcctgtcacttctgcacctctg

SEQ ID NO: 470 - protein, 309 aa, Populus trichocarpa
  POPTR_0014s12090.1 polypeptide
MCGGAILAGLIPHRGHRVAASEFWPNSSFNKPSPFDTYPSPLRNQEPFTLKRPQPTSGDHEQVEKPNAKRQRKNLYRGIRQRPWGKWAAEIRDPRKGVRVWLGTFNTAEEAARAYDREARKIRGKKAKVNFPNEDDHYYTSQNSNTKPFLYQAPTCHFSKGYDSGNVYDAYQIETFHSNGLINEPIVSSGEDDSRSGSEEVTGLLGCNQNVESNNYMGQVKVEEEKLEEKKVMNKEVMVVDLETGEEESEVQKLTEELMAYENFMKFYQIPYLDGQSTAPNGTTQESLVGNLWSFFDDGVDAPVTSAPL

SEQ ID NO: 471 - DNA, 930 bp, Eucalyptus grandis
  Eucgr.H01085.1
atgtgtggcggtgctatcatcgctgaattcatcccccggaaccgacgccgcgtcacctcctccgacctctggcccgactccctgttcctcaagccctcgaacggcctcgacgacccgctccccccgaaacaacacccctgccccgcctcaggtggcgcgcaggaagagaaggccccgaagaagccgcggaagaacctgtaccgtgggatccggcagcgcccgtggggcaagtgggcggcggagatccgcgacccgaggaagggcgtccgggtctggctcgggacgttcaacacggccgaggaggccgcgcgggcttacgaccgggaggcccgtaagatccgcggcaagaaggccaaggtgaatttccccaacgaggacgacgccttctccaccatcccgcgggctcaccagacccagcaccaccaccacccccaggtcccggactaccctcctctgtatcaacccaactggaacaacaacggggcacccgccaaaactctggacttggccttcgcttacgacctgaaccagacggggcatttccccgcgaacggctacgccccgatccacgccgagcccgtggccatgtccagcgaagagatctccgggtcgggctcggaggacacgcacgcctcgtcgacggccgcgctgctgggcgccaactacggcgccgccgaagcgaaggtgaaggcggagggggaggtggggaagaagaaagaggaggacgaggagagcgaggtgcagaagctgtcggaggagctcctggcgttcgagaactacatgaagttctaccagattccctacctggacggccagtccgccgccgcgccgccgaatcccgctcaggatagcgtcgtgggcgagctctgggccttcgacgacgacaacgacaacgcctccggcgtaaccgccgtggctccggccgctctc

SEQ ID NO: 472 - protein, 310 aa, Eucalyptus grandis
  Eucgr.H01085.1 polypeptide
MCGGAIIAEFIPRNRRRVTSSDLWPDSLFLKPSNGLDDPLPPKQHPCPASGGAQEEKAPKKPRKNLYRGIRQRPWGKWAAEIRDPRKGVRVWLGTFNTAEEAARAYDREARKIRGKKAKVNFPNEDDAFSTIPRAHQTQHHHHPQVPDYPPLYQPNWNNNGAPAKTLDLAFAYDLNQTGHFPANGYAPIHAEPVAMSSEEISGSGSEDTHASSTAALLGANYGAAEAKVKAEGEVGKKKEEDEESEVQKLSEELLAFENYMKFYQIPYLDGQSAAAPPNPAQDSVVGELWAFDDDNDNASGVTAVAPAAL

SEQ ID NO: 473 - DNA, 777 bp, Vitis vinifera
  GSVIVT01028050001
atgtgtggaggtgctatcatctctgatttcatacctcgcaaccggaaccgccgcgacccagccccagacctctggccggactctttcttcgctaaacccgatggctgtgaatacgatttgggccgctttagccagaaggggcttcctaatctgaaaaggtctcaacccattttggatgatgagccagaagtgaagccggctaagagggtgaggaagaatctgtacagggggatccggcagcgtccttggggaaaatgggcggctgagattcgtgatcccagtaaaggggttcgggtttggctcgggaccttcaacactgcggaagaagctgcgagagcttacgacagggaggctcggaaaattcgggggaagaaagcaaaggttaacttccccaatgaagacgatgactacactgagaatcaccaaaatcaccgtgctctaccaactcgctggaactccaatccttctatttcattcccctccaatgggttcaacaccaaagcctgtgttgggaaagtgaaaaatcagaaagagaaccaaacagagactgtgacggaagctgagaaggaggaaatggaagtgcagaagctgtcggaggagctaatggcgtatgagtcggtcatgaagttctatcagatcccctatctcgacggcaactcagccgcggttcccaacgctgctcaggaaaatgctggtgcttgcggtggtgctgccatggaagctctttggagctttgatgaatttgcagttgctcctcaacccacctcagctgctcta

SEQ ID NO: 474 - protein, 259 aa, Vitis vinifera
  GSVIVT01028050001 polypeptide
MCGGAIISDFIPRNRNRRDPAPDLWPDSFFAKPDGCEYDLGRFSQKGLPNLKRSQPILDDEPEVKPAKRVRKNLYRGIRQRPWGKWAAEIRDPSKGVRVWLGTFNTAEEAARAYDREARKIRGKKAKVNFPNEDDDYTENHQNHRALPTRWNSNPSISFPSNGFNTKACVGKVKNQKENQTETVTEAEKEEMEVQKLSEELMAYESVMKFYQIPYLDGNSAAVPNAAQENAGACGGAAMEALWSFDEFAVAPQPTSAAL

SEQ ID NO: 475 - DNA, 780 bp, Solanum lycopersicum
  Solyc09g075420.2.1
atgtgtggtggtgcaattcttgctgatatcattcctcctcgtgaccgccgtttgtcatccaccgacctatggccgactgatttctggccaatttccacccaaaatgttcctctcaaccccaaacgagctcgaccctctacaggtggtgagcagatgaagaagaggcaaaggaagaatctttacagagggataagacaacgtccatggggtaaatgggctgctgaaattcgtgacccgagaaaaggggttagggtttggttaggtactttcaacactgctgaagaagctgcaagagcttatgatagagaagctcgtaaaatcaggggtaagaaagctaaagttaatttccccaatgaagatgacgaccattactgctacagtcatccagagccccctcccttgaacattgcttgtgatactactgttacttacaatcaagaatcaaataactgttaccccttttactcaatcgagaacgttgaacctgttatggaatttgcaagttataatggaattgaagatggaggagaggagatggtgaaaaatttgaataacagggttgtagaggaagaggagaaaacagaggatgaagtgcagatactttctgatgagctgatggcttatgagtcattgatgaagttctatgaaataccgtatgttgacgggcaatcagtggcggcgacggtgaatccagcggcggagaccgccgtgggcggtggctcgatggagctttggagttttgatgatgttagtcgtctacaaccaagttataatgtagtt

SEQ ID NO: 476 - protein, 260 aa, Solanum lycopersicum
  Solyc09g075420.2.1 polypeptide
MCGGAILADIIPPRDRRLSSTDLWPTDFWPISTQNVPLNPKRARPSTGGEQMKKRQRKNLYRGIRQRPWGKWAAEIRDPRKGVRVWLGTFNTAEEAARAYDREARKIRGKKAKVNFPNEDDDHYCYSHPEPPPLNIACDTTVTYNQESNNCYPFYSIENVEPVMEFASYNGIEDGGEEMVKNLNNRVVEEEEKTEDEVQILSDELMAYESLMKFYEIPYVDGQSVAATVNPAAETAVGGGSMELWSFDDVSRLQPSYNVV

SEQ ID NO: 477 - DNA, 759 bp, Citrus clementina
  clementine0.9_019525m
atgtgtggcggtgcacttattgctgattatgatgaagtccggccggtcaggcgcgagcgcaaattgacctccgaggatctctggtccgagtttggttccatttccgacctcttgggcttggactacaatggcaaatcccaccctaagcaacctctcaaagtgaaaaatgagaaggctgaagattcaagcaataaagctgctcgtgttgaggggaaggagaagaagactcagcgagttcgcaagaacctgtacagaggaatacggcagaggccgtggggaaaatgggcagctgaaattagagacccttacaagggcgtccgcgtttggctcggcactttcaacacagccgaagaagccgcaagagcttatgatgaagccgccaagcgtatccgcggcgacaaggccaagctcaacttcgctcagccgccgccgccaatagctccacccccagctaagaaacgctgcatgccatcccctgagttgactcagccgagatttgaaaccatcggaaccccaccggctccggcgccgtccccgtgggtggggtttgggtatcagaatgagttttatcaacccagggcagtagacgacgagtttgagctgagccagcaaatttcgagcttggaatcgtttttgggattggagccattaatgagtcagccgagtggaaacggtgctggtgggtatgactcggtggacttttggatgcttgatgacgtggcggcgactcagcagctgaacagcaatcagttcttgtgt

SEQ ID NO: 478 - protein, 253 aa, Citrus clementina
  clementine0.9_019525m polypeptide
MCGGALIADYDEVRPVRRERKLTSEDLWSEFGSISDLLGLDYNGKSHPKQPLKVKNEKAEDSSNKAARVEGKEKKTQRVRKNLYRGIRQRPWGKWAAEIRDPYKGVRVWLGTFNTAEEAARAYDEAAKRIRGDKAKLNFAQPPPPIAPPPAKKRCMPSPELTQPRFETIGTPPAPAPSPWVGFGYQNEFYQPRAVDDEFELSQQISSLESFLGLEPLMSQPSGNGAGGYDSVDFWMLDDVAATQQLNSNQFLC

SEQ ID NO: 479 - DNA, 729 bp, Eucalyptus grandis
  Eucgr.H03965.1
atgtgtggaggcgccatcatttccgacttcgtcgaggagcggctcgaccgccgccgccccgggagctgccgccccgagaggaagctgacccctcacgagctctggtccgagctcgaccccgcctccgacctcctcagcctcgacggccccgtggcccaaggccaccccaaccctttctctctcgtcgcaaaccaactcaaccaagtgatgaagagtgaagagaagaacagtgaggaggcgggtcacggacacgtgtcggagacccagaagagccagagcaatggccggagccagagggctcgcaagaacgtgtacagagggatccggcagaggccgtggggcaagtgggccgccgagatcagggatccccacaagggcgtccgcgtctggctcggcaccttcaagaccgccgaggaggcggcgcgggcctacgacgaagccgccaagcgcatccgcggcgacaaggccaagctcaacttctccggccccccggccccggcccagccgtcagctaagaagaggtgcgtggctcctgacgagccgaaggatgaggccggagctgcaggatgtgagctgaaggagcggatcgccagcttggaatctttcctggagctggagccagccgaggagccgctcgagccgggcaccgggccgtccccggctgatctctggatgctcgaagacctcgtcactcatcaccagcaccgtttcgataaccagcttgtttat

SEQ ID NO: 480 - protein, 243 aa, Eucalyptus grandis
  Eucgr.H03965.1 polypeptide
MCGGAIISDFVEERLDRRRPGSCRPERKLTPHELWSELDPASDLLSLDGPVAQGHPNPFSLVANQLNQVMKSEEKNSEEAGHGHVSETQKSQSNGRSQRARKNVYRGIRQRPWGKWAAEIRDPHKGVRVWLGTFKTAEEAARAYDEAAKRIRGDKAKLNFSGPPAPAQPSAKKRCVAPDEPKDEAGAAGCELKERIASLESFLELEPAEEPLEPGTGPSPADLWMLEDLVTHHQHRFDNQLVY

SEQ ID NO: 481 - DNA, 777 bp, Vitis vinifera
  GSVIVT01035098001
atgtgtggaggtgcaattatatccggcttcatcgccgcaaagcgtggccggaaactcaccaaggaggacctctggtcggagctcgataccatctcggacctcctcggtttggattctgctaacggcggtgatgatttcaacccgtctgaaaatagggttgctccaaagccaaagcaagtgagcaaagggacgaacgagaatacccagaaagcgattcgggtggaggaaaagaagagtaccaccactccgaggattcggaagaacgtgtacagaggaatccggcagcggccttggggaaaatgggcggcggagattcgggacccgcacaagggtgtgagagtgtggctcggcacctacaacaccgccgaggaagccgccagagcctacgacgaagccgccaagagaatcagaggcgacaaggccaagctcaacttcgctgatccctcctctccccacttccctccgcccatcccactgccgccatccaaaagacgatgcgttgttccagaccccacagcacagtcaagttatcagccgaccgtaccaccaccaccattaatgacctatcctgctccgtacgagaacgaagcagcgagcgagttggagtttaaggagcaaatctcgagcttggaatcgctcctgggtttggagccggaacaggccgccactcagttgaacgaaatcaccgagtcagactcggtcgacctctggatgctggaggaccttgcttccactcaccctcaccaccatcgtcagcatgtatgcagcgctgcgttt

SEQ ID NO: 482 - protein, 259 aa, Vitis vinifera
  GSVIVT01035098001 polypeptide
MCGGAIISGFIAAKRGRKLTKEDLWSELDTISDLLGLDSANGGDDFNPSENRVAPKPKQVSKGTNENTQKAIRVEEKKSTTTPRIRKNVYRGIRQRPWGKWAAEIRDPHKGVRVWLGTYNTAEEAARAYDEAAKRIRGDKAKLNFADPSSPHFPPPIPLPPSKRRCVVPDPTAQSSYQPTVPPPPLMTYPAPYENEAASELEFKEQISSLESLLGLEPEQAATQLNEITESDSVDLWMLEDLASTHPHHHRQHVCSAAF

SEQ ID NO: 483 - DNA, 765 bp, Populus trichocarpa
  POPTR_0008s23260.1
atgtgtggaggtgccattatttccgattttgttactgttaagcgtggccggagattgacagttgaggatctctggtctgaacttgaccccttctctgaatttcttagatttgattatcactctaatgataataatggtagtaaaaaagacccatcaaatctcttgttccctcagaagccaagctacaccatccaagtccagcaagtgataacagagaaagttgagaagccaagccatgccacagagaaagaaaatggtaacaagaaggctcaaagaaccagaaagagtgtgtatagaggaataaggcaaaggacatggggcaaatgggcagctgaaataagagacccacacaaaggtgctagagtttggcttggcacatacaacaccgctgaggaagccgccaaagcatatgatgaagccgctaaacgcatccgtggtgataaagccaagctcaacttcccttctcagacaccgccaactccggaggcgccaccacctgccaagaagcgttgcatcgtggctcctgaaacagcttatgtggctagtcctttcacaccaccgctgcaagagccatattctgggtatcaaaatgaagattatgagctggaagagcaaatcttgaagttggagtcgtttcttgggctggaacctgaccagatggctgctcgtctgagggaaaacggcggtgataatcgtgactctggggacctttggatgcttgatgatcttgtgacacatcatcagtatcgacgtcagattaattat

SEQ ID NO: 484 - protein, 255 aa, Populus trichocarpa
  POPTR_0008s23260.1 polypeptide
MCGGAIISDFVTVKRGRRLTVEDLWSELDPFSEFLRFDYHSNDNNGSKKDPSNLLFPQKPSYTIQVQQVITEKVEKPSHATEKENGNKKAQRTRKSVYRGIRQRTWGKWAAEIRDPHKGARVWLGTYNTAEEAAKAYDEAAKRIRGDKAKLNFPSQTPPTPEAPPPAKKRCIVAPETAYVASPFTPPLQEPYSGYQNEDYELEEQILKLESFLGLEPDQMAARLRENGGDNRDSGDLWMLDDLVTHHQYRRQINY

SEQ ID NO: 485 - DNA, 744 bp, Populus trichocarpa
  POPTR_0010s00900.1
atgtgtggaggtgccatcatttccgatttcgtatccgttaaacgtggccggaaaccgaccactgaggatctctggtctgaacttgactccttatctgattttcttggacttgatcatcgttctatgaacaatattaataatggtagcaaaaaagaaaacctatcaaatctcaagctcgctcaaaagccacgccagcccaaccaagtgataacagagagagttgagaagccaagccaagcaacagagcaagaagccggtaaaaagaaggttcagagaaccagaaagaatgtgtatagaggaataaggcaaaggccatggggtaaatgggcagctgaaataagagacccacacaaaggtgttagagtttggctgggcacttacaacacagctgatgaagcagctaaagcttatgatgaagccgccaagcgcatccgtggagataaagccaagctcaacttcccccctcagccaccaccaacgtcggaggcggcgccaccaccaccaccaaagtcggaggcggcgccaccacctgccaagaaacgttgcatcttgggtcctgaaacggctgctatggctagttttgagcaaatcttgaacttggagtcgtttcatggcctggaaacgaagcagacggcggcccagctgagttgtgacggaggtggaagtggtgattataattgtgactctgtggacccttggatgcttgatgatcttatcaacatcagcttaattattagtaaaata

SEQ ID NO: 486 - protein, 248 aa, Populus trichocarpa
  POPTR_0010s00900.1 polypeptide
MCGGAIISDFVSVKRGRKPTTEDLWSELDSLSDFLGLDHRSMNNINNGSKKENLSNLKLAQKPRQPNQVITERVEKPSQATEQEAGKKKVQRTRKNVYRGIRQRPWGKWAAEIRDPHKGVRVWLGTYNTADEAAKAYDEAAKRIRGDKAKLNFPPQPPPTSEAAPPPPPKSEAAPPPAKKRCILGPETAAMASFEQILNLESFHGLETKQTAAQLSCDGGGSGDYNCDSVDPWMLDDLINISLIISKI

SEQ ID NO: 487 - DNA, 762 bp, Solanum lycopersicum
  Solyc01g065980.2.1
atgtgtggaggtgccataatctccgattatgatcccgccggaagcttctaccggaaactttctgctcgtgacctctgggctgagctggaccctatctccgactactggtcctcttcttcctcatcctcaaccgtcggaaaacctgattccgctctgtcgccggtgactcactccgtcgataagcctaataaatcagattccggcaaaaaaggtaataagactgtgaaggttgagaaggagaagagtagtggaccaaggccaaggaagaacaagtacagaggaataagacagaggccatggggaaaatgggctgctgagattcgcgatccacagaagggtgtacgcgtttggcttggtacattcaacacagcagaagatgctgctagagcctatgatgaggctgctaagcgcattcgtggtgataaggctaaactcaactttccagccccatcaccaccagctaagcgacagtgcactagcactgtcgctgctgctgatacaccaccagcactactccttgagagttctgacaactctcctttgatgaactttggatatgatgtccagtatcagagccaaactccctactaccccatggaaatgcccatagttagtgaagattatgaactgaaggaacagatttccaatttggaatcgttcctggaattggagccatctgatcaattttcagggatcgtcgattctgatcctcttaatgtttttctgatggaggactttgcttcaactcatcatcagttctac

SEQ ID NO: 488 - protein, 254 aa, Solanum lycopersicum
  Solyc01g065980.2.1 polypeptide
MCGGAIISDYDPAGSFYRKLSARDLWAELDPISDYWSSSSSSSTVGKPDSALSPVTHSVDKPNKSDSGKKGNKTVKVEKEKSSGPRPRKNKYRGIRQRPWGKWAAEIRDPQKGVRVWLGTFNTAEDAARAYDEAAKRIRGDKAKLNFPAPSPPAKRQCTSTVAAADTPPALLLESSDNSPLMNFGYDVQYQSQTPYYPMEMPIVSEDYELKEQISNLESFLELEPSDQFSGIVDSDPLNVFLMEDFASTHHQFY

SEQ ID NO: 489 - DNA, 783 bp, Arabidopsis thaliana
  ERF058 (AT1G22190.1 or G974)
atgacaacttctatggatttttacagtaacaaaacgtttcaacaatctgatccattcggtggtgaattaatggaagcgcttttaccttttatcaaaagcccttccaacgattcatccgcgtttgcgttctctctacccgctccaatttcatacgggtcggatctccactcattttctcaccatcttagtcctaaaccggtctcaatgaaacaaaccggtacttccgcggctaaaccgacgaagctatacagaggagtgagacaacgtcactggggaaaatgggtggctgagattcgtttaccgaggaatcgaactcgactttggctcggaacattcgacacggcggaggaagctgctttagcttatgacaaggcggcgtataagctccgaggagattttgcgcggcttaatttccctgatctccgtcataacgacgagtatcaacctcttcaatcatcagtcgacgctaagcttgaagctatttgtcaaaacttagctgagacgacgcagaaacaggtgagatcaacgaagaagtcttcttctcggaaacgttcatcaaccgtcgcagtgaaactaccggaggaggactactctagcgccggatcttcgccgctgttaacggagagttatggatctggtggatcttcttcgccgttgtcggagctgacgtttggtgatacggaggaggagattcagccgccgtggaacgagaacgcgttggagaagtatccgtcgtacgagatcgattgggattcgattcttcagtgttcgagtcttgtaaat

SEQ ID NO: 490 - protein, 261 aa, Arabidopsis thaliana
  ERF058 (AT1G22190.1 or G974) polypeptide
MTTSMDFYSNKTFQQSDPFGGELMEALLPFIKSPSNDSSAFAFSLPAPISYGSDLHSFSHHLSPKPVSMKQTGTSAAKPTKLYRGVRQRHWGKWVAEIRLPRNRTRLWLGTFDTAEEAALAYDKAAYKLRGDFARLNFPDLRHNDEYQPLQSSVDAKLEAICQNLAETTQKQVRSTKKSSSRKRSSTVAVKLPEEDYSSAGSSPLLTESYGSGGSSSPLSELTFGDTEEEIQPPWNENALEKYPSYEIDWDSILQCSSLVN

SEQ ID NO: 491 - DNA, 1002 bp, Arabidopsis thaliana
  AT1G78080.1
atggcagctgctatgaatttgtacacttgtagcagatcgtttcaagactctggtggtgaactcatggacgcgcttgtaccttttatcaaaagcgtttccgattctccttcttcttcttctgcagcgtctgcgtctgcgtttcttcacccctctgcgttttctctccctcctctccccggttattacccggattcaacgttcttgacccaaccgttttcatacgggtcggatcttcaacaaaccgggtcattaatcggactcaacaacctctcttcttctcagatccaccagatccagtctcagatccatcatcctcttcctccgacgcatcacaacaacaacaactctttctcgaatcttctcagcccaaagccgttactgatgaagcaatctggagtcgctggatcttgtttcgcttacggttcaggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatctcacatcggaggcgatttcggtgaatataaacctcttcactcctcagtcgacgctaagcttgaagctatttgtaaaagcatggcggagactcagaaacaggacaaatcgacgaaatcatcgaagaaacgtgagaagaaggtttcgtcgccagatctatcggagaaagtgaaggcggaggagaattcggtttcgatcggtggatctccaccggtgacggagtttgaagagtccaccgctggatcttcgccgttgtcggacttgacgttcgctgacccggaggagccgccgcagtggaacgagacgttctcgttggagaagtatccgtcgtacgagatcgattgggattcgattctagct

SEQ ID NO: 492 - protein, 334 aa, Arabidopsis thaliana
  AT1G78080.1 polypeptide
MAAAMNLYTCSRSFQDSGGELMDALVPFIKSVSDSPSSSSAASASAFLHPSAFSLPPLPGYYPDSTFLTQPFSYGSDLQQTGSLIGLNNLSSSQIHQIQSQIHHPLPPTHHNNNNSFSNLLSPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGSHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 493 - DNA, 783 bp, Arabidopsis thaliana
  AT2G22200.1
atggaaactgcttctctttctttccctgtcccaaacacgagcttcggtgtaaacaaatctatgcctctcggtctaaaccagctcacaccataccaaattcatcagattcagaaccagcttaaccatagacgtagcacaatctcaaacctctctccaaaccgtatcagaatgaagaacttaacaccttctacctccaaaaccaagaatctctacagaggcgtaaggcaaaggcactgggggaaatgggtcgctgagatccgtttgcccaagaaccggacccgtctctggctcgggacattcgaaaccgccgaaaaagccgccttagcttacgaccaagctgcttttcagctccgtggagatatcgcgaagcttaacttcccaaacctcatacacgaagacatgaatcctctcccttcctctgttgataccaagcttcaagctatctgcaaaagtttgagaaaaacagaggaaatttgctctgtttctgatcaaacaaaggagtactctgtttactctgtttcagataaaacagagcttttcctgccaaaagcagagcttttcttgcctaaaagagagcatttggagacaaatgagctctctaatgagtcaccgagaagcgatgagacctcgttgttggatgagtcgcaggcggaatattcatcgtcggataaaacattcctggatttctcggatactgagtttgaagagattggaagtttcgggcttcggaagtttccttcggtggagattgattgggatgcaattagtaaactggccaattct

SEQ ID NO: 494 - protein, 261 aa, Arabidopsis thaliana
  AT2G22200.1 polypeptide
METASLSFPVPNTSFGVNKSMPLGLNQLTPYQIHQIQNQLNHRRSTISNLSPNRIRMKNLTPSTSKTKNLYRGVRQRHWGKWVAEIRLPKNRTRLWLGTFETAEKAALAYDQAAFQLRGDIAKLNFPNLIHEDMNPLPSSVDTKLQAICKSLRKTEEICSVSDQTKEYSVYSVSDKTELFLPKAELFLPKREHLETNELSNESPRSDETSLLDESQAEYSSSDKTFLDFSDTEFEEIGSFGLRKFPSVEIDWDAISKLANS

SEQ ID NO: 495 - DNA, 831 bp, Arabidopsis thaliana
  AT5G65130.1
atggctttaaacatgaatgcttacgtagacgagttcatggaagctcttgaaccattcatgaaggtaacttcatcttcttctacttcgaattcatcaaatccaaaaccattaactcctaatttcatccctaataatgaccaagtcttaccggtatctaaccaaaccggtccgattgggctaaaccagctcactccaacacaaatcctccaaattcagacagagttacatctccggcaaaaccaatctcgtcgtcgcgctggtagtcatcttctcaccgctaaaccaacctcaatgaagaaaatcgacgtagcaactaaaccggttaaactataccgaggcgtaagacagaggcaatggggtaaatgggtagctgagattcggctacctaaaaaccgaacccggttatggctcggtacgttcgaaacggctcaagaagctgcattagcttacgatcaagcagctcataagatcagaggagacaacgctcgtctcaatttcccagacattgttcgtcaaggacactataaacagatattgtctccgtctatcaacgcaaagatcgaatccatctgcaatagttctgatcttccactgcctcagatcgagaaacagaacaaaacagaggaggtgctctctggtttttccaaaccggagaaagaaccggaatttggggagatatacggatgcggatactcgggctcatctcctgagtcggatataacgttgttggatttctcaagcgactgtgtgaaagaagatgagagtttcttgatgggtttgcacaagtatccttctttggagattgattgggacgctatagagaaactcttc

SEQ ID NO: 496 - protein, 277 aa, Arabidopsis thaliana
  AT5G65130.1 polypeptide
MALNMNAYVDEFMEALEPFMKVTSSSSTSNSSNPKPLTPNFIPNNDQVLPVSNQTGPIGLNQLTPTQILQIQTELHLRQNQSRRRAGSHLLTAKPTSMKKIDVATKPVKLYRGVRQRQWGKWVAEIRLPKNRTRLWLGTFETAQEAALAYDQAAHKIRGDNARLNFPDIVRQGHYKQILSPSINAKIESICNSSDLPLPQIEKQNKTEEVLSGFSKPEKEPEFGEIYGCGYSGSSPESDITLLDFSSDCVKEDESFLMGLHKYPSLEIDWDAIEKLF

SEQ ID NO: 497 - DNA, 834 bp, Solanum lycopersicum
  Solyc04g054910.2.1
atggcagcagctatagatgtatacagcagcagcagtaacttgtcagatcctttaacagaagaacttatgaaagcacttgaaccttttatgaaaggtatcttgcaaatccaagctcagatccaatttcaaaatcaacagcaacaactacaactattacatcaacaacaacagagcttagtcccaatgaagcaaacgggtgctacttcttcacagaaggctactaagctttatcgtggagttagacaacgccattggggcaaatgggttgctgaaattagacttcctaagaacagaactaggctttggttaggcacttttgatacagctgaagaggctgctttggcttatgacaaagctgcttataagctaagaggtgagtttgctaggcttaattttccacatctaaggcatcaattaaacaatgaattctctgatttcaagcctttgcattcctctgtggatgctaaacttcaagccatttgccaaagcttggctaatcccaaatcagatgactcgtgttctaaatctaattccaagccaagaaagtccaaaactgcagcagtttcagtggattcaaattcagctcaagaatcttcatcaaagtcagaaatcaccacagatgattcattgaaagaagaattcagctatccagaaaatggtactatcaagattgaggcttcatcatcatcatcaccccctacaccctctgaggaatcatcatcttcgtctgagtctgatattactttcttggatttcgctgaaccatctttcgatgaatcagaaaacttctttttacccaagtacccttccgtggagattgattgggcagctctt

SEQ ID NO: 498 - protein, 278 aa, Solanum lycopersicum
  Solyc04g054910.2.1 polypeptide
MAAAIDVYSSSSNLSDPLTEELMKALEPFMKGILQIQAQIQFQNQQQQLQLLHQQQQSLVPMKQTGATSSQKATKLYRGVRQRHWGKWVAEIRLPKNRTRLWLGTFDTAEEAALAYDKAAYKLRGEFARLNFPHLRHQLNNEFSDFKPLHSSVDAKLQAICQSLANPKSDDSCSKSNSKPRKSKTAAVSVDSNSAQESSSKSEITTDDSLKEEFSYPENGTIKIEASSSSSPPTPSEESSSSSESDITFLDFAEPSFDESENFFLPKYPSVEIDWAAL

SEQ ID NO: 499 - DNA, 1116 bp, Populus trichocarpa
  POPTR_0005s07900.1
atggcagcagctatcgatatctacaacacaacagtgccagttttttcagatccttgtagagaagaactcatgaaagcacttgaaccttttatgaaaagtgcttcgccatcaccaacttccacttattcttcaccttctccatcaacttcttctcctcctttctcttctcacccttcttgcttttacaacaataactctctcatctcttcatatcccaacttggaccttagcttttgctctccaacgagcacccagatgttttctaatgggttcttggattataaccaaatgggttttgagcaaacaggtccaattgggcttaaccaccttacaccttcacaaatcctccaaatccaagccaaaatccacttccaacaacaacagcagcagaaaatggaaaatcttgctaccaccacatcacagtttgtccataaccaaagggctagtaacttcttggctccaaaacctgtccctatgaaacaatctgctgcttctcctcaaaagccaacaaagctttatagaggagtcaggcagaggcattggggaaaatgggttgctgagattagacttccaaagaacagaactagactctggcttggcacttatgacacagctgaagaggcagctttggcttatgataatgctgcttataagctgagaggagaatatgctaggcttaactttccacatcttcgccaccagggagctcatgtgtctggtgaatttggtgattacaagcctctccattcctctgttgatgcaaagttacaagcaatttgtcaaagcctgggcttgcaaaaacaggggaaaacaagggagcccagctctgttgctaattccaaaaagactgcaacagctcctttgcaagcaaaaattgaagatgattgttctttgagaggcgaattgaaaacggagtatgagaattttggagttgaggactataaggtggagatcccatcaccatcaccagcttcatctgacgaatcattggctggttcttcttcaccagaatctgagatttctttcttggatttctctggttctttacagtgggacgagtttgagaattttggtttggagaagtacccttcagttgagattgactggtcatccatc

SEQ ID NO: 500 - protein, 372 aa, Populus trichocarpa
  POPTR_0005s07900.1 polypeptide
MAAAIDIYNTTVPVFSDPCREELMKALEPFMKSASPSPTSTYSSPSPSTSSPPFSSHPSCFYNNNSLISSYPNLDLSFCSPTSTQMFSNGFLDYNQMGFEQTGPIGLNHLTPSQILQIQAKIHFQQQQQQKMENLATTTSQFVHNQRASNFLAPKPVPMKQSAASPQKPTKLYRGVRQRHWGKWVAEIRLPKNRTRLWLGTYDTAEEAALAYDNAAYKLRGEYARLNFPHLRHQGAHVSGEFGDYKPLHSSVDAKLQAICQSLGLQKQGKTREPSSVANSKKTATAPLQAKIEDDCSLRGELKTEYENFGVEDYKVEIPSPSPASSDESLAGSSSPESEISFLDFSGSLQWDEFENFGLEKYPSVEIDWSSI

SEQ ID NO: 501 - DNA, 1125 bp, Populus trichocarpa
  POPTR_0007s05690.1
atggcagcagctatagatatctacaacactacagtaccagttttttcagatccttgtagaggagaactcatggaagcacttgaaccttttatgaaaagtgcttcaccatcaccagcttctacttcttattcttcacaatctccttcaacttcttcttattctttctcttcttatccttcttgctatcacaacaattgcttcccagtcacttcacatcccaacttggaccttaacttttacactccaacgagcacccagatgttttctaatgggttctcgggttataaccaaatgggttttgagcaaacaggtccaattgggctgaaccaccttaccccttcacaaatccttcaaatccaagccaaaatccacctccaacagcagcagcagcagcagcaaatggcaaatcatgctcccgctcccacatcacagttagtccataaccaaaggactagcaatttcttggctccaaaacctgtccctatgaaacaacaatctgcttctcctcctccaaagccaacaaagctttatagaggagtgaggcagagacattggggaaaatgggttgctgagattagacttccaaagaacagaacaagactctggcttggcacttttgacacagctgaggaggcagctttggcttatgataaggctgcttataagctgagaggagaatttgccaggctcaactttccacatcttcgccaccaaggagctcatgtgtctggtgaatttggtgactacaagcctctccattcctctgttgatgcgaagttgcaagcaatttgtcagagcctgggtttgcaaaaacagggggaaacaggggaaccctgttctgtttctgattcaaagaagaccgtttcagctcctttgcaggtgaaaattgaagatgattgttctttgcaaggagaattgaaaagggagttcgagaatctcggagttgaggaatttaaagtggagatcccatcaccctcaccagctctatctgatgagtcattggctggttcttcttcaccagaatctgagatttctttctttttctctgattctttacaatgggacgagtttgagaattttggtttggagaagtatccttcagttgagattgactggtcatctatc

SEQ ID NO: 502 - protein, 375 aa, Populus trichocarpa
  POPTR_0007s05690.1 polypeptide
MAAAIDIYNTTVPVFSDPCRGELMEALEPFMKSASPSPASTSYSSQSPSTSSYSFSSYPSCYHNNCFPVTSHPNLDLNFYTPTSTQMFSNGFSGYNQMGFEQTGPIGLNHLTPSQILQIQAKIHLQQQQQQQQMANHAPAPTSQLVHNQRTSNFLAPKPVPMKQQSASPPPKPTKLYRGVRQRHWGKWVAEIRLPKNRTRLWLGTFDTAEEAALAYDKAAYKLRGEFARLNFPHLRHQGAHVSGEFGDYKPLHSSVDAKLQAICQSLGLQKQGETGEPCSVSDSKKTVSAPLQVKIEDDCSLQGELKREFENLGVEEFKVEIPSPSPALSDESLAGSSSPESEISFFFSDSLQWDEFENFGLEKYPSVEIDWSSI

SEQ ID NO: 503 - DNA, 810 bp, Vitis vinifera
  GSVIVT01002262001
atggcagcggcaatagatatatacagtagcagcaggacagtcttctcagaaagagaagaacttatgaaagcacttgaaccttttatgaaagggttctcaggttacgaccaaatgggtcttgagcaaacacgttcaatcgggctaaaccacatcaccccagctcagattctccaaattcaagcccaaatccaccaatggcagcagcaacataacctaaacttcctcggccccaaagccatccccatgaagcaggttggaactcccccgaaaccagctaagctctatcgaggagtgagacagcggcattggggaaaatgggttgcggagatcagacttcctaagaaccgtacccgcctgtggcttggcactttcgatactgcagaagaagcggctttggcctatgataaggccgcttttaagctcaggggagagttcgccaggctcaatttcccaaatctccggcaccaagggtcacttgttgcaggcgaattcggggactacaagcctctccactcctcagtggatgcgaagcttcaagccatttgccaaaacttggctatttcgcagaaacaggggaattcagggaagcctggcctagtcgccgatgcaaagattgaaagttccacccatcaggcggaaatgatctcatcatcatcgtcatccccttctccatccgatgaatcatctgcgggttcatcatcgcctgaatcagatatttccttcttggatttcactgattcacagtggaatgactcggagtgcttgacgttggagaagtttccttctgtggagattgattgggcatccatc

SEQ ID NO: 504 - protein, 270 aa, Vitis vinifera
  GSVIVT01002262001 polypeptide
MAAAIDIYSSSRTVFSEREELMKALEPFMKGFSGYDQMGLEQTRSIGLNHITPAQILQIQAQIHQWQQQHNLNFLGPKAIPMKQVGTPPKPAKLYRGVRQRHWGKWVAEIRLPKNRTRLWLGTFDTAEEAALAYDKAAFKLRGEFARLNFPNLRHQGSLVAGEFGDYKPLHSSVDAKLQAICQNLAISQKQGNSGKPGLVADAKIESSTHQAEMISSSSSSPSPSDESSAGSSSPESDISFLDFTDSQWNDSECLTLEKFPSVEIDWASI

SEQ ID NO: 505 - DNA, 936 bp, Glycine max
  Glyma05g31370.1
atgggaaccgctataggcatgtacagcaacaacaacatcgtaccggatttcctagatccgtatagtgaagaactgatgaaagcacttatgccttttatgaaaagtgattatttctctgcctcttcttcttcttcttcacgcgaatcacacccttctcctcttattccatctaattctctcccctcctccaaccaaatcaggctcaaccaactcacccaagaccaaattctccagattcaggcccaaatccacattcagcagcagcacgtggcccaaggccaagcccacctgggcccaaaacgcgtccctatgaaacacgccggcacggccgcgaaagccgcgaagctctaccgcggggtgcggcaacggcattggggcaagtgggtcgccgaaatcagactccccaagaaccgcacgcgcctctggctcggaacattcgacaccgcagaggaagcagcattagcgtacgacaacgctgcgtttaagctcagaggcgagttcgcgcgtctcaatttccctcatctacgacaccacggagcgtttgttttcggtgagttcggagattacagacctctaccttcttccgtggattcgaagctgcaagctatttgcgaaagcttggcgaaacaagaggaaaagccgtgttgctctgtcgaagacgtgaagcccgtgatacacgctgctgagctggcagaggtggagtctgacgtggcaaaattgaacgctgaatatgtttatcccgagttcgaggattttaaggtcgagaacgagaacccaatgttgtcctcgtctgtgtctggcgaatcttcttcgcctgaatctggtgttactttcttggatttctcggacttctcggattctaataatcagtgggatgaaatggagaattttgggttggagaagttcccttctgtggagattgattgggcggcaata

SEQ ID NO: 506 - protein, 312 aa, Glycine max
  Glyma05g31370.1 polypeptide
MGTAIGMYSNNNIVPDFLDPYSEELMKALMPFMKSDYFSASSSSSSRESHPSPLIPSNSLPSSNQIRLNQLTQDQILQIQAQIHIQQQHVAQGQAHLGPKRVPMKHAGTAAKAAKLYRGVRQRHWGKWVAEIRLPKNRTRLWLGTFDTAEEAALAYDNAAFKLRGEFARLNFPHLRHHGAFVFGEFGDYRPLPSSVDSKLQAICESLAKQEEKPCCSVEDVKPVIHAAELAEVESDVAKLNAEYVYPEFEDFKVENENPMLSSSVSGESSSPESGVTFLDFSDFSDSNNQWDEMENFGLEKFPSVEIDWAAI

SEQ ID NO: 507 - DNA, 936 bp, Glycine max
  Glyma08g14600.1
atgggaactgctatagacatgtacaacagcagcaacatcgtagcggatttcctagatccgtatagtgaagagctgatgaaagcacttaagccttttatgaaaagtgattatttctctgcctcttcttcttcttcactcgaatcacagccttgttctttttcatctaattctctccccacttcgtatccctcttccaaccaaatcaagctcaaccaactcaccccagaccaaattgttcagattcaggcccaaatccacattcagcagcagcagcagcacgtggcccaaacccaaacccacctgggcccaaaacgcgtccccatgaagcacgctggcacggccgcgaaacccacgaagctctaccgcggggtgcggcaacggcattggggcaagtgggtcgctgaaatcagactcccaaagaaccgcacgcgcctctggctaggaacattcgacaccgcagaggaagcagcattagcgtacgacaacgcagcgtttaagctcagaggcgagttcgcgcgtctcaattttcctcatctaagacaccacggagccttcgttttcggcgagttcggagattacaagcctctaccttcttccgtggattccaaactgcaagctatttgcgaaagcttagcgaaacaagaggaaaagccgtgttgctccgtcgaagacgtgaagcccgtgatacacgctgctgagctggcagaggtcgagtctgacgtggcaaaatcgaacgctgaatatgtttatcccgagttcgaggattttaaggtcgagcacgagaacccaatgttttctggtgaatcttcttcgcctgaatccagtgttactttcttggatttctcggacttctcggattctaataatcagtgggatgaaatggagaattttgggttggagaagttcccttctgtggagattgattgggaagctata

SEQ ID NO: 508 - protein, 312 aa, Glycine max
  Glyma08g14600.1 polypeptide
MGTAIDMYNSSNIVADFLDPYSEELMKALKPFMKSDYFSASSSSSLESQPCSFSSNSLPTSYPSSNQIKLNQLTPDQIVQIQAQIHIQQQQQHVAQTQTHLGPKRVPMKHAGTAAKPTKLYRGVRQRHWGKWVAEIRLPKNRTRLWLGTFDTAEEAALAYDNAAFKLRGEFARLNFPHLRHHGAFVFGEFGDYKPLPSSVDSKLQAICESLAKQEEKPCCSVEDVKPVIHAAELAEVESDVAKSNAEYVYPEFEDFKVEHENPMFSGESSSPESSVTFLDFSDFSDSNNQWDEMENFGLEKFPSVEIDWEAI

SEQ ID NO: 509 - DNA, 933 bp, Glycine max
  Glyma13g01930.1
atggcagctacgatgaatttctacaacgaaacatcacaacaagttcagtcagatccattcagaggagagctcatggaagttctagaaccttttatgaaaacttgtccttcctcaactccctctattctctcctcagattcaccatcaccttcctcttactctcctttactacctccacaccccagtttctccacatacaccccctctgcctacttattccaaaaccaacaacccttaataggctttgagcaacaaccaagttcccttctcgggctcaaccacctaagcacgtctcagatttcccagatccaagcccaagcccaagcccagaactcgctctctcttaatttcttgggccccaagcccgttcctatgaagcacgttggtgggccggcgaagcccacgaagctgtaccggggcgtgaggcagaggcattgggggaagtgggtggcggagataaggctaccgaagaaccgaaccaggctttggctcggaaccttcgacacagccgaggaagccgctttggcttacgacaaagccgcgtacaggctccgaggcgacttggcgaggctgaacttcccgaacctgaaaggctcgtgccccggcgaggagtacaagcctatgcaggctgcggtggacgctaagctcgacgcaatctgcgcgaacttggcggaaatgcagaagcaagggaagaacgagaagggtgccaggtcggggaagaagtcgaagcaaggtccgaacctggaggcgaagcccgaacctgaagcttcgggttccggtgctgctgctctgtctcctgaaagtgagggttctgcggattcttctgctttgtctgatcttacctttgatgtaaccgagccgcaatgggaggatgcttcagcacattttaatttgcaaaagtttccttcttatgagatcgattgggattctctc

SEQ ID NO: 510 - protein, 311 aa, Glycine max
  Glyma13g01930.1 polypeptide
MAATMNFYNETSQQVQSDPFRGELMEVLEPFMKTCPSSTPSILSSDSPSPSSYSPLLPPHPSFSTYTPSAYLFQNQQPLIGFEQQPSSLLGLNHLSTSQISQIQAQAQAQNSLSLNFLGPKPVPMKHVGGPAKPTKLYRGVRQRHWGKWVAEIRLPKNRTRLWLGTFDTAEEAALAYDKAAYRLRGDLARLNFPNLKGSCPGEEYKPMQAAVDAKLDAICANLAEMQKQGKNEKGARSGKKSKQGPNLEAKPEPEASGSGAAALSPESEGSADSSALSDLTFDVTEPQWEDASAHFNLQKFPSYEIDWDSL

SEQ ID NO: 511 - DNA, 927 bp, Glycine max
  Glyma18g02170.1
atggcaacagttatggacatgtacaatactagtagcatcatgataccagatttcttagaccagtgtagtgatcaagagctgatgaaagcacttgagccttttatgaaaagtgattcatctagcattacatacccttcattctcttccttttcttcttctcccaatttctcttcaacaacaagctacgagcaaaaggtttcaataactccaaaccatgctagttccatcaaactgaaccaactcaccccatcacagatgtttcaaattcaagcccgaatccaggttccacgaggccagtttctgagcccaaagcccattcccatgaagcacgtgcgggcttctccttcttcaaagcccacgaagctttaccgtggggtgaggcagagacactggggcaagtgggtcgctgagatcagactccccaagaaccgaacacgtctctggctaggtacatttgacaccgcagaggaagcagcgttggcttacgacaacgcagcgtttaagctaagaggagaaaacgcgaggctcaacttccctcacctgcgtcaccatggagcacgcgcgtacggtgagtttgggaactacaagcctctcccctctgcggtcgatgcgaagcttcaagccatttgtcaaagcttggggaccaattcgcagaaactcaaaactcaaaaccctattgttctagatacacacaaggcagagacagagacatcggagtttcaggattttaataaggttgagaattaccaaacatcatcgtcctcggccttctccgatgaatattcttcttcttcttcttcttcttcacctgaatccgatattaccctcttggatttctcggattcttgtgaaacaatggacaatcttgggttggacttggagaagtacccttccgtggagattgattgggcagctttatctgactca

SEQ ID NO: 512 - protein, 309 aa, Glycine max
  Glyma18g02170.1 polypeptide
MATVMDMYNTSSIMIPDFLDQCSDQELMKALEPFMKSDSSSITYPSFSSFSSSPNFSSTTSYEQKVSITPNHASSIKLNQLTPSQMFQIQARIQVPRGQFLSPKPIPMKHVRASPSSKPTKLYRGVRQRHWGKWVAEIRLPKNRTRLWLGTFDTAEEAALAYDNAAFKLRGENARLNFPHLRHHGARAYGEFGNYKPLPSAVDAKLQAICQSLGTNSQKLKTQNPIVLDTHKAETETSEFQDFNKVENYQTSSSSAFSDEYSSSSSSSSPESDITLLDFSDSCETMDNLGLDLEKYPSVEIDWAALSDS

SEQ ID NO: 513 - DNA, 936 bp, Glycine max
  Glyma14g34590.1
atggcagctacgatgaatttctacaacggaacatcacaagaacaagttgagtcagatccattcagaggtgagctcatggaagttctagaaccttttatgaaaactagtccttcctcaacaactccctctattattctctcttcagattcaccttcatcttcatcttttaatttcccttcctcttctttactttctccacaccccaatttctacacacacactccccccccttcctacttactccaaagccaacaatccttaataggctttgagcaaccaccgagttcccttctcgggctcaaccacctaagcccgtctcagatttctcagatccaggcccagatcgaggcccaacagagccaaaaccagaacccacactctctcaactttctcggcccgaagcccgtcccaatgaagcacgtgggcgggcctccgaagcccacgaagctgtaccggggcgtaaggcagaggcattgggggaagtgggtggcggagatcaggctcccgaagaaccgaaccaggctctggctcggaaccttcgacacggcggaggaagctgctttggcttacgacaaagccgcgtataggctccgaggcgacttcgcgaggctgaacttcccgagcctgaaaggctcgtgccccggggaggagtacaagcctgtgcattccgcggtggacgctaagctcgacgcgatttgcgccaacttggcggaaatgcagaagcaagggaagacggagaaaggtgccaggtcagcgaagaaatcgaagcaaggtccgaaccaggaggccaagcccgaacctcaagcttccgctgaaagtgagggttctgcggattcttctccgctgtctgatcttacctttgatgtaaccgagccgcaatgggaacattttaatttgcagaagtttccttcttatgagatcgattgggattctctc

SEQ ID NO: 514 - protein, 312 aa, Glycine max
  Glyma14g34590.1 polypeptide
MAATMNFYNGTSQEQVESDPFRGELMEVLEPFMKTSPSSTTPSIILSSDSPSSSSFNFPSSSLLSPHPNFYTHTPPPSYLLQSQQSLIGFEQPPSSLLGLNHLSPSQISQIQAQIEAQQSQNQNPHSLNFLGPKPVPMKHVGGPPKPTKLYRGVRQRHWGKWVAEIRLPKNRTRLWLGTFDTAEEAALAYDKAAYRLRGDFARLNFPSLKGSCPGEEYKPVHSAVDAKLDAICANLAEMQKQGKTEKGARSAKKSKQGPNQEAKPEPQASAESEGSADSSPLSDLTFDVTEPQWEHFNLQKFPSYEIDWDSL

SEQ ID NO: 515 - DNA, 942 bp, Glycine max
  Glyma04g11290.1
atggcagctatgatggatttttacagcagcagcacagagtttcaacttcactcagatccattcaggggtgaactaatggaagttcttgaaccttttatgaaaagtcctttctcaaccccttctccttcaaattcttgttttctttctacctcttactctccttcccccaacaactactctccctccctatactcaaacgggttatcatccatacccaacaccacccaaaacttaattggtttcgggcaagggcagcccacatctcttgtgggcctgaaccacctaaccccatctcagatctctcagatccaggcccaaatccagatccagaatcacagcaacacgctgagcttcctggggccgaagcccatccctatgaagcacgtgggcatgcctccgaagcccacgaagctatacagaggggttcgacagaggcactgggggaagtgggtggctgagattagactcccgaagaaccggaccaggctatggctgggaaccttcgacaccgccgaggaagccgctctggcgtacgacaaggccgcgtacaagctccgaggtgacttcgccaggctcaacttccccaacctccgacaccagggttcctccgtcggtggtgacttcggggagtataagcctcttcattccgccgttgacgccaagcttcaggccatttgcgagggcctggctgagctgcagaaacaggggaagaccgagaagcctccgaggaaaacgcgatccaaactcgcttctccgccagagaacgacaacaacaacgacaacaactcttgtaaggtcgaagctgcttcctcctcttctgaaggttcttcgccgctttcggttctgactttcgctgacgtcagcgagccgcagtgggaaggtgattcggataattttaatctccagaagtacccctcttatgagatcgactgggattctctg

SEQ ID NO: 516 - protein, 314 aa, Glycine max
  Glyma04g11290.1 polypeptide
MAAMMDFYSSSTEFQLHSDPFRGELMEVLEPFMKSPFSTPSPSNSCFLSTSYSPSPNNYSPSLYSNGLSSIPNTTQNLIGFGQGQPTSLVGLNHLTPSQISQIQAQIQIQNHSNTLSFLGPKPIPMKHVGMPPKPTKLYRGVRQRHWGKWVAEIRLPKNRTRLWLGTFDTAEEAALAYDKAAYKLRGDFARLNFPNLRHQGSSVGGDFGEYKPLHSAVDAKLQAICEGLAELQKQGKTEKPPRKTRSKLASPPENDNNNDNNSCKVEAASSSSEGSSPLSVLTFADVSEPQWEGDSDNFNLQKYPSYEIDWDSL

SEQ ID NO: 517 - DNA, 906 bp, Glycine max
  Glyma06g11010.1
atggcagctttgatggatttttacagcagcagcccagagtttcaacttcactcagatccattcaggggagaactaatggaagttcttgaaccttttatgaaaagtccttctcccaactatttcccttcctccccctccctccctaatctttactcaaacgggttatccagcaacacccaaagcttaattggcttcgggcaagcgcaacccacatctcttgtgggcctgaaccacctaaccccatctcagatctctcagatccaagcccaaatccagatccaggcccagcagcatcagaatcgcagcaacaccctgagcttccttgggccgaagcccatccccatgaagcacgcgggcatgcctccgaagcccacgaagctttacagaggggtgagacagaggcactggggaaagtgggtggctgagatcagacttcccaagaaccggaccaggctgtggctgggaaccttcgacaccgccgaggaagccgctctggcatacgacaaggccgcgtacaagctccgaggtgacttcgccaggctcaacttcccaaacctgcgacaccagggttcctccgtcggtggtgatttcggggagtacaagcctcttcattccgctgttgacgccaagcttcaggccatttgcgaaggcctggctgagctgcagaaacaggggaagaccgagaagcctccgaggaagtcgcgttccaaactcgcggagaaggttgtttccgacaaggagaacaacaactcttgtaaggtggaagctgcgtcctggtcgtcggaaggttcttcgccgctttcggatctgacgtttgctgacgtgagcgaggctcagtgggaaggtgattcggataattataatctccagaagtacccctcttatgagatcgattgggattctctg

SEQ ID NO: 518 - protein, 302 aa, Glycine max
  Glyma06g11010.1 polypeptide
MAALMDFYSSSPEFQLHSDPFRGELMEVLEPFMKSPSPNYFPSSPSLPNLYSNGLSSNTQSLIGFGQAQPTSLVGLNHLTPSQISQIQAQIQIQAQQHQNRSNTLSFLGPKPIPMKHAGMPPKPTKLYRGVRQRHWGKWVAEIRLPKNRTRLWLGTFDTAEEAALAYDKAAYKLRGDFARLNFPNLRHQGSSVGGDFGEYKPLHSAVDAKLQAICEGLAELQKQGKTEKPPRKSRSKLAEKVVSDKENNNSCKVEAASWSSEGSSPLSDLTFADVSEAQWEGDSDNYNLQKYPSYEIDWDSL

SEQ ID NO: 519 - DNA, 1032 bp, Populus trichocarpa
  POPTR_0002s09480.1
atggatttccacagtagtagtccgcttcaatcagacctcctcgggggtggggagttaatggaagctcttgaaccttttatgagaagtgcttccccttcaactaccccatctccttctcaaacctctaactatccttcttctccttctcccccctctacatcatccaatcggttttctttctccccacaaccaccacagcaacatcaacagtcccttttcaacccagatggttgctgctctacgtcgacaacctatccattttcaactgggttgtcgttcaacgacccaatgggtctccagcaaccatccagttcaattgggcttaaccaccttacaccaacccaggtccaccagatccaaacccagatgcaccataataacctctcatatcttcaagcttaccaacaaccccaaaccctcaaattcttatccccaaagccgatccccatgaaacaaatcggcacaccaccaaaagccacaaaactttatagaggagtaaggcaaaggcactggggcaaatgggtcgctgagatccgtttgcccaagaaccgaacccgactctggcttggcacatttgacacagcagaggaggcagctttggcttatgacagagcagcttataaactaagaggcgactttgcaagactgaacttcccaaacttactccaccaagggtcctacatcggcgaatacaagcctctccattcctcagtggatgcgaaacttcaagctatttgtaaaagcttggagaactcttcgcagcagaaacaaggagggaaagcaaagaggcaaagtaactcgacgaagaagaaagccaacttggcagtggtgacccaggaggaggagcaagtggttgttaaggctgagacagagtccccggcattgacggagagtactgcgtcgggtggatcttcgcctttgtcggatctgacgtttccggattttgaggaagcaccgttggattttgaatcggggaattttatgttgcagaagtatccctcttatgagattgattgggcttcaattttatct

SEQ ID NO: 520 - protein, 344 aa, Populus trichocarpa
  POPTR_0002s09480.1 polypeptide
MDFHSSSPLQSDLLGGGELMEALEPFMRSASPSTTPSPSQTSNYPSSPSPPSTSSNRFSFSPQPPQQHQQSLFNPDGCCSTSTTYPFSTGLSFNDPMGLQQPSSSIGLNHLTPTQVHQIQTQMHHNNLSYLQAYQQPQTLKFLSPKPIPMKQIGTPPKATKLYRGVRQRHWGKWVAEIRLPKNRTRLWLGTFDTAEEAALAYDRAAYKLRGDFARLNFPNLLHQGSYIGEYKPLHSSVDAKLQAICKSLENSSQQKQGGKAKRQSNSTKKKANLAVVTQEEEQVVVKAETESPALTESTASGGSSPLSDLTFPDFEEAPLDFESGNFMLQKYPSYEIDWASILS

SEQ ID NO: 521 - DNA, 1053 bp, Populus trichocarpa
  POPTR_0005s16690.1
atggcagctacaatggatctctacagtagcatatcgcttcaatcagatcccttggtgggcgagttaatggaagcacttgaaccttttatgaaaagtgcttcctcaatagctaccccatctccttctcaaacccctaactatccttcttctccttctttaccttctctcccttctacttcttacgattacttcttttctttctctacaccatcacatctacagcaacagcaacagccctttttgtacccagacgtttgctgctccacatcgacggcctacccattttcaactgggttctcgattaacgacgcaatgggtctccagcagccatctagttcaattgggctcaaccaccttaccccaaaccagatccaccagatccaaacccaaatccaccaaaataacagccactcttaccttcgaacttgccaacaaccgcaaaccctcaaatttttatctccgaagccagtccccatgaaacaaatgggtacaccatcaaaatccacgaagctttacagaggagtaaggcaaaggcactggggcaagtgggtcgctgagatccgtttacccaagaatagaacccgtctctggctcggcacctttgacacagcagaggaggcggctttggcttatgacaaagcagcttacaaactcagaggcgactttgcaaggcttaacttccctaatctacgccaccaagggtcccacatcggcgagtacaagcctctccattcctcggttgatgcgaaactccaagctatttgcgagagcttggagaattcttcgcagcagaaacgaggaaaagtagagaagcgaagtaactcgaccaagaaggaaaccagcttggtggtggggacacaggaggaggagccggtggtcaagtctgagacaccgtccccggtgttgacggagagtgatgggtcgggtggatcttcgcccttgtctgatctgacgtttccggatattgaggaagcaccgttagagtttgactcggggaattttatgttgcagaagtatccttcttacgagattgattgggcttcaattttatct

SEQ ID NO: 522 - protein, 351 aa, Populus trichocarpa
  POPTR_0005s16690.1 polypeptide
MAATMDLYSSISLQSDPLVGELMEALEPFMKSASSIATPSPSQTPNYPSSPSLPSLPSTSYDYFFSFSTPSHLQQQQQPFLYPDVCCSTSTAYPFSTGFSINDAMGLQQPSSSIGLNHLTPNQIHQIQTQIHQNNSHSYLRTCQQPQTLKFLSPKPVPMKQMGTPSKSTKLYRGVRQRHWGKWVAEIRLPKNRTRLWLGTFDTAEEAALAYDKAAYKLRGDFARLNFPNLRHQGSHIGEYKPLHSSVDAKLQAICESLENSSQQKRGKVEKRSNSTKKETSLVVGTQEEEPVVKSETPSPVLTESDGSGGSSPLSDLTFPDIEEAPLEFDSGNFMLQKYPSYEIDWASILS

SEQ ID NO: 523 - DNA, 843 bp, Vitis vinifera
  GSVIVT01009007001
atgaaaaatgcttcttctacttccccttcttcaaccctatctccttcgtcttcaccttctacctcttctttctatccttcatccgatttctactctcctatctcaacccagtatccagatggatgctcgacctcgaccacccatgtaatttcccaagggttctcgagtcatgacctacagggtttcgagcattcgggtccaattgggctcaatcacctaacaccctctcagattcaccagatccaagcccagatccagcttcagcaacaccacaaccacatgcctgcccccatccccatgaagcaagtgggcgtacctccaaaacccacaaagctctatagaggggtgagacaacggcattggggaaaatgggtcgccgagatccgacttcccaagaaccgaaccaggctctggcttggcaccttcgacaccgccgaagaagccgccttggcttacgacaaggccgcgtacaaacttagaggtgacttcgcgaggcttaatttcccaaatctccgccaccaaggatcccatatcggaggcgaatttggggactacaagcctctccattcctcagttgacgcaaagcttcaagccatttgccagagcttggctgaaacccagaaacaggggaagcctacccagggcaagaaatccaggtcgcgggcggtggcgccctctgcgtcacagccgagtgatgggtccggaggatcctcgcccctctcggatcttactttcccagatgattgcgaagaagcaccgttctacggtgcttgggagaatttcaatttgcagaaatatccctctaacgagatcgattgggcagctatttcatcccaatggcca

SEQ ID NO: 524 - protein, 281 aa, Vitis vinifera
  GSVIVT01009007001 polypeptide
MKNASSTSPSSTLSPSSSPSTSSFYPSSDFYSPISTQYPDGCSTSTTHVISQGFSSHDLQGFEHSGPIGLNHLTPSQIHQIQAQIQLQQHHNHMPAPIPMKQVGVPPKPTKLYRGVRQRHWGKWVAEIRLPKNRTRLWLGTFDTAEEAALAYDKAAYKLRGDFARLNFPNLRHQGSHIGGEFGDYKPLHSSVDAKLQAICQSLAETQKQGKPTQGKKSRSRAVAPSASQPSDGSGGSSPLSDLTFPDDCEEAPFYGAWENFNLQKYPSNEIDWAAISSQWP

SEQ ID NO: 525 - DNA, 921 bp, Solanum lycopersicum
  Solyc12g056980.1.1
atggctacttctactatggatttttggactactactcttttagatcttaactcatcaaattctggtggtgagcttatggaagcacttgcaccttttattaaaagtgcttcttctccttctccttctccttctgtttctccgtcttttgatttacaatcttcttctttatcaacttcatttctttacgaatcattttcttcaacgagtcaacccaatatgagctcaattgggctgaaccaagcccaaatctatctatcgcagcaagttatgccagctgtcactttccaaaataataatcagtatgcttcttacttggggccaaagcccgtttccatgaagcaaacgggctcgcccccaaaacccccaaagctataccgcggtgttagacaacgccattgggggaaatgggtggcagagattcgattgcctaaaaacaggacccggctttggctaggtacatttgatactgctgaggaggccgccttggcatatgacaaggcggcttataaactcagaggcgagtttgctcgtttgaatttcccccatctccgtcataacggatcattaattgggagtgaattcggtgagtataagccgcttcactcctcagttaatgctaagttacaagccatttgtcaagacttggcacaaggaaagagcattgatactaaaaagaagcgaaaagtgtcttctaaggcgatgatggtggaggtggaggagaaagaatataagaaaagcaagacaacggcagaagctgggtcggaaagtgatggatccggatcagggtcaggatcaggatctggttctggatcatcaccaatttcggaatatactttcgattcaatttgggacatgtgttcagaaaattatgtgttgcacaaggatccatctcaagagatttttaattgggcttcactacta

SEQ ID NO: 526 - protein, 307 aa, Solanum lycopersicum
  Solyc12g056980.1.1 polypeptide
MATSTMDFWTTTLLDLNSSNSGGELMEALAPFIKSASSPSPSPSVSPSFDLQSSSLSTSFLYESFSSTSQPNMSSIGLNQAQIYLSQQVMPAVTFQNNNQYASYLGPKPVSMKQTGSPPKPPKLYRGVRQRHWGKWVAEIRLPKNRTRLWLGTFDTAEEAALAYDKAAYKLRGEFARLNFPHLRHNGSLIGSEFGEYKPLHSSVNAKLQAICQDLAQGKSIDTKKKRKVSSKAMMVEVEEKEYKKSKTTAEAGSESDGSGSGSGSGSGSGSSPISEYTFDSIWDMCSENYVLHKDPSQEIFNWASLL

SEQ ID NO: 527 - DNA, 846 bp, Brachypodium distachyon
  Bradi4g29010.1
atggctgcagctatagatctgtccggggaagagctgatgagagcactcgagccttttatccgggatgcctctgcttcccctcctccactcaactcacatcccagccccacctcgccattctccttcccccacgccgcgtaccaagggtacccgtacggggtgcaggcccaggcccaggccgagctcagcccggccgagatgcactacatccaggcacgcctccacctccagcgccagaccggcccgccgggccacctcggcccgcgggcccagcccatgaagccggcttccacggcggcggcgaccccgccgcggccgcagaagctttaccgcggcgtgcggcagcggcactggggcaagtgggtggccgagatccgcctcccccgcaaccgcacccgcctctggctcggcaccttcgacaccgccgaggaagccgccctcgcctacgaccaggccgcgtaccgcctccgcggggacgccgcgcggctcaacttccccgacaacgccgcctcccgcggccccctcgacgcctccgtcgacgccaagctccagaccctctgccagaacatcaccgcctccaagaacgccaagaagtccaagtcatcctccgcttccgcagccacttcatccacccccacaagcaactgctcttcgccgtcttccgacgaggcgtcgtcctctctggagtcggcggagtcatcgccgtcgcccgccaccaacgcagcagaggttccggagatgcagcagctcgacttcagcgaggcgccatgggacgaggccgcaggattcgccctcaccaagtacccctcgtacgagatcgactgggactcgctcctcgccaccaac

SEQ ID NO: 528 - protein, 282 aa, Brachypodium distachyon
  Bradi4g29010.1 polypeptide
MAAAIDLSGEELMRALEPFIRDASASPPPLNSHPSPTSPFSFPHAAYQGYPYGVQAQAQAELSPAEMHYIQARLHLQRQTGPPGHLGPRAQPMKPASTAAATPPRPQKLYRGVRQRHWGKWVAEIRLPRNRTRLWLGTFDTAEEAALAYDQAAYRLRGDAARLNFPDNAASRGPLDASVDAKLQTLCQNITASKNAKKSKSSSASAATSSTPTSNCSSPSSDEASSSLESAESSPSPATNAAEVPEMQQLDFSEAPWDEAAGFALTKYPSYEIDWDSLLATN

SEQ ID NO: 529 - DNA, 840 bp, Oryza sativa
  LOC_Os08g31580.1
atggcagctgctatagaaggaaatctgatgcgggcgctgggagaggctccgtcgccgcagatgcagaagatcgcgccgccgccgtttcatcccggcttgccgccggcgccggcgaacttctcctcggccggagtccacgggttccactacatgggcccggcccagctcagcccggcccagatccagcgcgtccaggcccaactccacatgcagcggcaggcccagtcggggctcggcccgcgggcccagcccatgaagcccgcttcggcggctgctccggcggcggcggcggcgcgggcgcagaagctgtaccgcggcgtgcggcagcggcactggggcaagtgggtggcggagatccggctgccgcgcaaccgcaccaggctctggctcggcaccttcgacaccgccgaggaggcggcgctcacctacgaccaggccgcgtaccgcctccgcggcgacgcggcgcggctcaacttcccggacaacgccgcgtcgcggggcccgctcgacgccgccgtggacgccaagctccaggccatctgcgacaccatcgccgcgtccaagaacgcctcatccaggtccaggggcggcgccggcagggccatgcccatcaacgcgcccctggtcgccgcggcgtcgtcgtcctccggctccgaccactccggcggcggcgacgacggcggctcggagacgtcgtcgtcgtctgcggcggcgtcgccgctggcggagatggagcagctggacttcagcgaggtgccgtgggacgaggcggaggggttcgcgctcaccaagtacccgtcgtacgagatcgactgggactcgctgctcaacaacaataac

SEQ ID NO: 530 - protein, 280 aa, Oryza sativa
  LOC_Os08g31580.1 polypeptide
MAAAIEGNLMRALGEAPSPQMQKIAPPPFHPGLPPAPANFSSAGVHGFHYMGPAQLSPAQIQRVQAQLHMQRQAQSGLGPRAQPMKPASAAAPAAAAARAQKLYRGVRQRHWGKWVAEIRLPRNRTRLWLGTFDTAEEAALTYDQAAYRLRGDAARLNFPDNAASRGPLDAAVDAKLQAICDTIAASKNASSRSRGGAGRAMPINAPLVAAASSSSGSDHSGGGDDGGSETSSSSAAASPLAEMEQLDFSEVPWDEAEGFALTKYPSYEIDWDSLLNNNN

SEQ ID NO: 531 - DNA, 948 bp, Zea mays
  GRMZM2G029323_T01
atggccgcagccatagacatgtacaagtactgcaataccagcgcacaccttatcgcctcctcgtccccctcggatcaggagctcgcgaaagcactcgagccttttataacgagtgcttcctccccctaccatcgctactcgttggccccagattcttacatgcctacaccctcctcctacaccacctcgcctcttcccacccccacctcctcgcctttctcgcagcttccgccactctactcgtcgccttacgcggcttcgacggcgtcgggcgtggctgggccgatgggcctgaaccagctcggcccggcccagatccagcagatccaggcccagctcatgttccagcaccagcagcagaggggcctgcacgcggcgttcctgggcccgcgggcgcagccgatgaagcagtccgggtcgccgccggcgcagtcgaagctgtaccgcggcgtgcgccagcgccactggggcaagtgggtggcggagatccgcctccccaagaaccgcacgcggctgtggctcggcaccttcgacaccgccgagggcgcggcgctggcctacgacgaggcggccttccgcctccgcggcgacacggcgcgcctcaacttcccgtccctccgccgcggcggcggcgcgcgcctcgccggcccgctccacgcctccgtggacgccaagctcaccgccatctgccagtccctggcggggtccaagaacagctcgtccagcgacgagtcggccgcgtccctgccggactcccccaagtgctcagcgtcgacggagggggatgaggactcggcctccgccggctcccctccttccccgacgcaggcgccgcccgtgccggagatggcgaagctggacttcaccgaggcgccgtgggacgaaacggaggccttccacctgcgcaagtacccgtcctgggagatcgactgggattccatcctctca

SEQ ID NO: 532 - protein, 316 aa, Zea mays
  GRMZM2G029323_T01 polypeptide
MAAAIDMYKYCNTSAHLIASSSPSDQELAKALEPFITSASSPYHRYSLAPDSYMPTPSSYTTSPLPTPTSSPFSQLPPLYSSPYAASTASGVAGPMGLNQLGPAQIQQIQAQLMFQHQQQRGLHAAFLGPRAQPMKQSGSPPAQSKLYRGVRQRHWGKWVAEIRLPKNRTRLWLGTFDTAEGAALAYDEAAFRLRGDTARLNFPSLRRGGGARLAGPLHASVDAKLTAICQSLAGSKNSSSSDESAASLPDSPKCSASTEGDEDSASAGSPPSPTQAPPVPEMAKLDFTEAPWDETEAFHLRKYPSWEIDWDSILS

SEQ ID NO: 533 - DNA, 990 bp, Setaria italica
  Si017760m
atggccgcagccatagatatgtacaagtattacaacactagtgcacaccagatcgccgcctcctcttcttcggatcaggagctcgcgaaagcactcgaaccttttataacgagtgcttcctcttcgtcttcctccccctaccactactactcttcttcttccatgacccaagattcttacatgcctacaccctcctacgccaccttcgccacctcgcctcttcccaccgccgccgccacctcctcgtcgtctttctcgcagcttccgccactctactcgtcgccttacgctgcttctgcggcgtcgggcgtgactggaccgatgggcctgaaccagctcggcccggcccagatccagcagatccaggcccagttcatgatgcagcagcagcagaggggcctgcacgcggcgttcctgggcccgcgggcgcagccgatgaagcagtccgggtcgccgccgttggcgccggcgcagtcgaagctgtaccgcggcgtacgccagcgccactggggcaagtgggtggcggagatccgcctccccaagaaccgcacgcggctgtggctgggcaccttcgacaccgccgaggacgcggcgctcgcctacgacaaggcggcgttccgcctccgcggcgacatggcgcgcctcaacttccccgccctccgccgcggcggcgcgcacctggccggcccgctccacgcctccgtggacgccaagctcaccgccatctgccagtccctcgccgggtccaagagcggctcccctgacgccgagtcctcggccgcgtccccgccggactcgcccaagtgctcggcgtcgacggagggggaggaggagtcggtctccgccggctccccgccttcaccgccgctggcgccgcccgtcccggagatggcgaagctggacttcacggaggcgccgtgggacgagacggaggccttccacctgcgcaagtacccgtcctgggagatcgactgggactccatcctctca

SEQ ID NO: 534 - protein, 330 aa, Setaria italica
  Si017760m polypeptide
MAAAIDMYKYYNTSAHQIAASSSSDQELAKALEPFITSASSSSSSPYHYYSSSSMTQDSYMPTPSYATFATSPLPTAAATSSSSFSQLPPLYSSPYAASAASGVTGPMGLNQLGPAQIQQIQAQFMMQQQQRGLHAAFLGPRAQPMKQSGSPPLAPAQSKLYRGVRQRHWGKWVAEIRLPKNRTRLWLGTFDTAEDAALAYDKAAFRLRGDMARLNFPALRRGGAHLAGPLHASVDAKLTAICQSLAGSKSGSPDAESSAASPPDSPKCSASTEGEEESVSAGSPPSPPLAPPVPEMAKLDFTEAPWDETEAFHLRKYPSWEIDWDSILS

SEQ ID NO: 535 - DNA, 1014 bp, Oryza sativa
  LOC_Os02g51670.1
atggccgcagcaatagacatgtacaagtataacactagcacacaccagatcgcatcctcggatcaggagctcatgaaagcgctcgaaccttttattaggagcgcttcttcttcctccgcttcctccccctgccaccactactactcttcttctccttccatgagccaagattcttacatgcccaccccatcttatcccacttcctctatcacaaccgccgccgccaccaccacctcgtctttctcgcagctacctccgctgtactcttcgcagtatcatgctgcttcacctgcggcgtcggcgacgaacgggccgatggggctgacccacctgggcccagcccagatccagcagatccaggcccagttcttggcccagcagcagcagcagagggccctggccggcgccttccttcggccgcgtggccagccgatgaagcagtccgggtcgccgccgcgcgcggggccgttcgcggcggtcgccggggcggcgcagtcgaagctctaccgcggagtgcggcagcgccactgggggaagtgggtggcggagatccgcctcccgaagaaccggacgcggctgtggctcggcaccttcgacaccgccgaggacgccgcgctcgcctacgacaaggccgccttccgcctccgcggcgacctcgcgcggctcaacttccccaccctccgccgcggcggcgcccacctcgccggcccgctccacgcctccgtcgacgccaagctcaccgccatctgccagtccctcgccacgagctcgtccaagaacacccccgccgagtcagcggcctccgcggcggagccggagtcccccaagtgctcggcgtcgacggaaggggaggactcggtgtccgccggctcccctcctccgcccacgccgctgtcgcccccggtgccggagatggagaagctggacttcacggaggcgccatgggacgagtcggagacattccacctgcgcaagtacccgtcctgggagatcgactgggactcaatcctctca

SEQ ID NO: 536 - protein, 338 aa, Oryza sativa
  LOC_Os02g51670.1 polypeptide
MAAAIDMYKYNTSTHQIASSDQELMKALEPFIRSASSSSASSPCHHYYSSSPSMSQDSYMPTPSYPTSSITTAAATTTSSFSQLPPLYSSQYHAASPAASATNGPMGLTHLGPAQIQQIQAQFLAQQQQQRALAGAFLRPRGQPMKQSGSPPRAGPFAAVAGAAQSKLYRGVRQRHWGKWVAEIRLPKNRTRLWLGTFDTAEDAALAYDKAAFRLRGDLARLNFPTLRRGGAHLAGPLHASVDAKLTAICQSLATSSSKNTPAESAASAAEPESPKCSASTEGEDSVSAGSPPPPTPLSPPVPEMEKLDFTEAPWDESETFHLRKYPSWEIDWDSILS

SEQ ID NO: 537 - DNA, 945 bp, Brachypodium distachyon
  Bradi3g58980.1
atggccgcagctatagacatgtacaagtacaacagcagcagcgcgcaccagatcgcctctgcttcagatcagcaggagctcatgaaagcactcgaaccttttatcaggagtgcttcttccaatccctatagctacaactactacccttctccttcgtcttcttcttcctccatgacccaagattcttcttacatcaccaccaacccatcgccgtacgcctctttcgccacatcccctgttccgacaaccaccgcccttccgccgctgtactcttcggccggggtgaacgggccgatcgggctggcccacctgggcccggcccagatccagcagatccaggcccagtttatcgcacagcagcagcagagggggatgggcctggcgggctcgttccttgggccgcgggggacgacgccgatgaagcagtactccgggtcgccgccgctgggggcgcagtcgaagctgtaccgcggcgtgcggcagcggcactgggggaagtgggtggcggagatccggctgccgaagaaccggacgcggctgtggctcggcaccttcgacgccgccgaggacgccgcgctcgcctacgacaaggccgccttccgcctccgcggcgaccaggcgcgcctcaacttcccggcgctccgccgcggcggcgcacacctcgccggcccgctccacgcctccgtcgacgccaagctcaccgccatctgccagtcgctccagaacccggccgcggcggagccggagtcgcccaagtgctcggcggcgtccgcgtccacggagggggacaacgattccgcgtcggcgtccgctgccgggtcgcccggggcgccggtgccggggatggagaagctggacttcacggaggcgccgtgggacgagtccgagaccttccacctgcgcaagtacccctccgtcgagatcgactgggactccatcctctcc

SEQ ID NO: 538 - protein, 315 aa, Brachypodium distachyon
  Bradi3g58980.1 polypeptide
MAAAIDMYKYNSSSAHQIASASDQQELMKALEPFIRSASSNPYSYNYYPSPSSSSSSMTQDSSYITTNPSPYASFATSPVPTTTALPPLYSSAGVNGPIGLAHLGPAQIQQIQAQFIAQQQQRGMGLAGSFLGPRGTTPMKQYSGSPPLGAQSKLYRGVRQRHWGKWVAEIRLPKNRTRLWLGTFDAAEDAALAYDKAAFRLRGDQARLNFPALRRGGAHLAGPLHASVDAKLTAICQSLQNPAAAEPESPKCSAASASTEGDNDSASASAAGSPGAPVPGMEKLDFTEAPWDESETFHLRKYPSVEIDWDSILS

SEQ ID NO: 539 - DNA, 1047 bp, Zea mays
  GRMZM5G852704_T01
atggcaacaacagatttgtacacaggccagctgagcttctcctcgtcgtcctcctcggaccaggagctcatgaaagcactcgaaccttttatccggagtgcttcttcacctacctcctccaccacctctcctttctcgtactcatcatattcatacccctactcctctgttctgcctcaagattcgtactacctccccgccacatcctcttacaccgcgctcccgccaccacctcttgctcccaccgccacctccttctcacagctcccgcctctgccccagtcctcctcgtcgtacgcctctccggcgtcgtcgtcgtgcccgacgtcgtcggtggacgccgcgtcggggctggcgctgaaccacctgggcccggcgcaaatccaccagatccattcgcagctcttggcacagcggcggcagcagcatcagaggggccagctggcggcggcgttcctcggcccgcaggcgcagcccatgaagcacgccggggcgccgccgctggcggctgcaaagctgtaccgcggcgttcggcagcggcactggggcaagtgggtggcggagatccgcctgcccaggaaccggacgcggctgtggctcggcaccttcgactccgccgaggacgcggcgctcgcctacgacaaggcggccttccgcctccgcggcgacgcggcgcgcctcaacttcccatccctccgccggggcggcgcgcacctcgcgggcccgctcgacgcctccgtcgacgccaagctcaccgccatctgccagggcatcaccgccgagcccacctccaaggccgccgccgccgctccctcggactcgcccaaggcctcggcgtccacgaccacgactgagggcgacgagtcggtgcactccgccggctcgcctccttccctccccacgttcccgcagcagcagcagcaggtgacgccgccgctccccgagatggcgagcctggacttcacggaggcgccgtgggacgagtccgccgccttgcacctcaactcgtacccgtcctgggacatcgactgggactccatcctctcg

SEQ ID NO: 540 - protein, 349 aa, Zea mays
  GRMZM5G852704_T01 polypeptide
MATTDLYTGQLSFSSSSSSDQELMKALEPFIRSASSPTSSTTSPFSYSSYSYPYSSVLPQDSYYLPATSSYTALPPPPLAPTATSFSQLPPLPQSSSSYASPASSSCPTSSVDAASGLALNHLGPAQIHQIHSQLLAQRRQQHQRGQLAAAFLGPQAQPMKHAGAPPLAAAKLYRGVRQRHWGKWVAEIRLPRNRTRLWLGTFDSAEDAALAYDKAAFRLRGDAARLNFPSLRRGGAHLAGPLDASVDAKLTAICQGITAEPTSKAAAAAPSDSPKASASTTTTEGDESVHSAGSPPSLPTFPQQQQQVTPPLPEMASLDFTEAPWDESAALHLNSYPSWDIDWDSILS

SEQ ID NO: 541 - DNA, 1041 bp, Setaria italica
  Si008385m
atggcagccatagatttggacacaaaccagctgagctcctcctcgtcgtcctcctcggaccaggagctcatgaaagcactcgaaccttttatccggagtgcttcttcccccacctcctccacctccaccaccacctcccccttctcctacccttacgtctaccactctgctttgcctcaagattcgtactactaccaacctgccgccgccgcctcttcttgcaccgcgctcccgccaccgccgccagctcccaccaccacctccttctcgcagctcccgcccctgccgccctgctcctcgtcgtacgccatgccgacggcgccgtaccagacgttgtcgatggacgccgcggcggggctggcgctgaaccacctgagcccggcgcaaatccagcagatccaggcgcagctcctgttgcggcagcagcagcggggcctggtggcgtcgctcctcggcccgcgggcgcagcccatgaagcaggccggggcggtggcgccgccatcgaccgcctcgaagctgtaccgcggcgtgcggcagcggcactggggcaagtgggtggcggagatccgcctgcccaggaaccggacgcggctgtggctcggcaccttcggctccgccgaggacgccgcgctcgcctacgacaaggcggccttccgcctccgcggcgacgcggcgcgcctcaacttcccgtccctccgccggggcggctcgcacctcgcgggcccgctcgacgcctccgtcgacgccaagctcacagccatctgccagggcctcgccgccgcgcccgattccaaatccgccgccgctgccccggaatcgcccaaggcctcggcgtccacgaccacgacggagggcgacgagtcggtgcactccgccggctcgcctcctcccctaccggcgttccagcagcagcagcagcaggtggcgccggtcccggagatggcgagcctggacttcacggaggcgccgtgggacgagtcagccgccttgcacctgaacaagtacccgtcatgggagatcgactgggactccatcctctcg

SEQ ID NO: 542 - protein, 347 aa, Setaria italica
  Si008385m polypeptide
MAAIDLDTNQLSSSSSSSSDQELMKALEPFIRSASSPTSSTSTTTSPFSYPYVYHSALPQDSYYYQPAAAASSCTALPPPPPAPTTTSFSQLPPLPPCSSSYAMPTAPYQTLSMDAAAGLALNHLSPAQIQQIQAQLLLRQQQRGLVASLLGPRAQPMKQAGAVAPPSTASKLYRGVRQRHWGKWVAEIRLPRNRTRLWLGTFGSAEDAALAYDKAAFRLRGDAARLNFPSLRRGGSHLAGPLDASVDAKLTAICQGLAAAPDSKSAAAAPESPKASASTTTTEGDESVHSAGSPPPLPAFQQQQQQVAPVPEMASLDFTEAPWDESAALHLNKYPSWEIDWDSILS

SEQ ID NO: 543 - DNA, 891 bp, Oryza sativa
  LOC_Os03g09170.1
atggcgacgacagtggattggtgtggccgtggcagcaatcttcctgctgcgatgtatgacatggtggtggatagcaaggagctaatgggcgcgcttgctccgtccatggtgtccttctcctacccgtgttccgagcagagcgcgagctcgcttcttgctggcgccaactacctgactcccgcgcaggtgctccatgtccaggcgcagctacagcgcctgcgccgcccgggcgcggcgagcggctgcctcgccgcggcgccgccgctgccgatgaagcggcatggcgcggtggcggtggcggcggcggcggcggcgcgggcgccggtcaagctgtaccgcggcgtcaggcagcggcattggggcaagtgggtggcggagatccgcctgccgcgcaaccgcacccgcctctggctgggcaccttcgacaccgccgaggaggccgcgctggcgtacgacagcgccgcgttccgcctccgcggcgagtccgcgaggctcaacttccccgagctccgccgcggcggcgcccacctcggcccgccgctccacgccgcggtcgacgccaagctccacgccatctgccacgggatggacctgccccaaccccaaccccaaacccagagcaatgcgacgacgacgacgatgtcgacgacggcgacgaacaccccaagccccttcttctcctcggagagcccggtggtcaagagcgagcccgtctgctccgcctccgagagctcttcctcggccgacggcgacgtgtcatcgacgggctcctccgacgtcgtcccggagatgcagctgctcgacttctcggaggcgccatgggacgagtccgagagcttcctgctgcacaagtacccgtcgctggagatcgactgggacgcgatcctttcc

SEQ ID NO: 544 - protein, 297 aa, Oryza sativa
  LOC_Os03g09170.1 polypeptide
MATTVDWCGRGSNLPAAMYDMVVDSKELMGALAPSMVSFSYPCSEQSASSLLAGANYLTPAQVLHVQAQLQRLRRPGAASGCLAAAPPLPMKRHGAVAVAAAAAARAPVKLYRGVRQRHWGKWVAEIRLPRNRTRLWLGTFDTAEEAALAYDSAAFRLRGESARLNFPELRRGGAHLGPPLHAAVDAKLHAICHGMDLPQPQPQTQSNATTTTMSTTATNTPSPFFSSESPVVKSEPVCSASESSSSADGDVSSTGSSDVVPEMQLLDFSEAPWDESESFLLHKYPSLEIDWDAILS

SEQ ID NO: 545 - DNA, 891 bp, Zea mays
  GRMZM2G113060_T01
atggcggctacgacgatagattggcacggccgcaacgccgccttgtatggcgtgccggacagcaaggagctggtgcgcgcgctggctccgcccatgcagcaggccccgaccatctcgttcgcgtacccctgcccaggcgtggagcagcagagccagtgcgcggcggcgggctcgtttctgggcgccggcggcctgaccccggcgcagcttctccaggtgcagtcgcggctccggttcctgcgccggccggcggcagcgggcggcgccgcgcagccgatgaagcggcagggcgtgccgcagcaggctccgcttcccgcgcggccggcggtgtccaagctgtaccgcggcgtccggcagcggcattggggcaagtgggtggcggagatccgcctgccgcgcaaccgcacccgcctctggctcggcaccttcgacaccgccgaggaggccgcgctcgcctacgacggcgccgcgttccgcctccgcggggactccgccaggctcaacttccccgagctcaggcgcggcgggcagcacctcggcccgccgctccacgccgcggtcgacgccaagctccacgccatctgcagcggcgcggacgtcggcgcgccgctgccgcagggccagagccagagccacgccacggcggcggcgactacagccaccccgagccccttctcctcggtgagcccacacgtcaagagtgagccgggctgctccgtctcagagagctcgttctctgcagacggcgacgtgtcctccactgggtcttccgacgtggtgccggagatgcagctgctcgacttctcggaagcgccatgggacgagtcagacagcttccaccttcgcaagtacccctccctggagatcgactgggactcgatactgatttca

SEQ ID NO: 546 - protein, 297 aa, Zea mays
  GRMZM2G113060_T01 polypeptide
MAATTIDWHGRNAALYGVPDSKELVRALAPPMQQAPTISFAYPCPGVEQQSQCAAAGSFLGAGGLTPAQLLQVQSRLRFLRRPAAAGGAAQPMKRQGVPQQAPLPARPAVSKLYRGVRQRHWGKWVAEIRLPRNRTRLWLGTFDTAEEAALAYDGAAFRLRGDSARLNFPELRRGGQHLGPPLHAAVDAKLHAICSGADVGAPLPQGQSQSHATAAATTATPSPFSSVSPHVKSEPGCSVSESSFSADGDVSSTGSSDVVPEMQLLDFSEAPWDESDSFHLRKYPSLEIDWDSILIS

SEQ ID NO: 547 - DNA, 816 bp, Arabidopsis thaliana
  AT4G39780
atggcagccatagatatgttcaatagcaacacagatccttttcaagaagagctcatgaaagcacttcaaccttataccaccaacactgattcttcttctcctacgtattcaaacacagtcttcggtttcaatcaaaccacatctctcggtctaaaccagctcacaccttaccaaatccaccaaatccaaaaccagcttaaccagagacgtaacataatctctccaaatctagccccaaagcctgtcccaatgaagaacatgaccgctcagaaactctatagaggagttagacaaaggcactggggaaaatgggtagctgagatccgtttacccaagaaccggacccgactctggcttggaactttcgacacagctgaagaagcagccatggcttatgacctagctgcttacaagctaagaggcgagttcgcgagacttaatttcccacagttcagacacgaggatggatactacggaggaggtagctgtttcaatcctcttcattcctctgtcgacgcaaagctccaagagatttgtcagagcttgagaaaaacagaggatattgacctcccctgttctgaaacagagcttttcccgccaaaaacagagtatcaagaaagtgaatatgggttcttgagatctgatgagaattcgttttcagatgagtctcatgtggaatcttcttcgccggaatctggtattactacgttcttggacttttcggattctggatttgatgagattgggagtttcgggctggagaagtttccttctgtggagattgattgggatgcgattagcaaattgtccgaatct

SEQ ID NO: 548 - protein, 272 aa, Arabidopsis thaliana
  AT4G39780 polypeptide
MAAIDMFNSNTDPFQEELMKALQPYTTNTDSSSPTYSNTVFGFNQTTSLGLNQLTPYQIHQIQNQLNQRRNIISPNLAPKPVPMKNMTAQKLYRGVRQRHWGKWVAEIRLPKNRTRLWLGTFDTAEEAAMAYDLAAYKLRGEFARLNFPQFRHEDGYYGGGSCFNPLHSSVDAKLQEICQSLRKTEDIDLPCSETELFPPKTEYQESEYGFLRSDENSFSDESHVESSSPESGITTFLDFSDSGFDEIGSFGLEKFPSVEIDWDAISKLSES

SEQ ID NO: 549 - protein, 64 aa, Arabidopsis thaliana
  AT1G22190.1 AP2 domain
LYRGVRQRHWGKWVAEIRLPRNRTRLWLGTFDTAEEAALAYDKAAYKLRGDFARLNFPDLRHND

SEQ ID NO: 550 - protein, 63 aa, Arabidopsis thaliana
  AT1G78080.1 AP2 domain
LYRGVRQRHWGKWVAEIRLPRNRTRLWLGTFDTAEEAALAYDKAAYKLRGDFARLNFPNLRHN

SEQ ID NO: 551 - protein, 64 aa, Arabidopsis thaliana
  AT2G22200.1 AP2 domain
LYRGVRQRHWGKWVAEIRLPKNRTRLWLGTFETAEKAALAYDQAAFQLRGDIAKLNFPNLIHED

SEQ ID NO: 552 - protein, 60 aa, Arabidopsis thaliana
  AT5G65130.1 AP2 domain
LYRGVRQRQWGKWVAEIRLPKNRTRLWLGTFETAQEAALAYDQAAHKIRGDNARLNFPDI

SEQ ID NO: 553 - protein, 66 aa, Solanum lycopersium
  Solyc04g054910.2.1  AP2 domain
LYRGVRQRHWGKWVAEIRLPKNRTRLWLGTFDTAEEAALAYDKAAYKLRGEFARLNFPHLRHQLNN

SEQ ID NO: 554 - protein, 62 aa, Populus trichocarpa
  POPTR_0005s07900.1 AP2 domain
LYRGVRQRHWGKWVAEIRLPKNRTRLWLGTYDTAEEAALAYDNAAYKLRGEYARLNFPHLRH

SEQ ID NO: 555 - protein, 62 aa, Populus trichocarpa
  POPTR_0007s05690.1 AP2 domain
LYRGVRQRHWGKWVAEIRLPKNRTRLWLGTFDTAEEAALAYDKAAYKLRGEFARLNFPHLRH

SEQ ID NO: 556 - protein, 62 aa, Vitis vinifera
  GSVIVT01002262001 AP2 domain
LYRGVRQRHWGKWVAEIRLPKNRTRLWLGTFDTAEEAALAYDKAAFKLRGEFARLNFPNLRH

SEQ ID NO: 557 - protein, 63 aa, Glycine max
  Glyma05g31370.1 AP2 domain
LYRGVRQRHWGKWVAEIRLPKNRTRLWLGTFDTAEEAALAYDNAAFKLRGEFARLNFPHLRHH

SEQ ID NO: 558 - protein, 63 aa, Glycine max; identical to SEQ ID NO: 557
  Glyma08g14600.1 AP2 domain

SEQ ID NO: 559 - protein, 67 aa, Glycine max
  Glyma13g01930.1 AP2 domain
LYRGVRQRHWGKWVAEIRLPKNRTRLWLGTFDTAEEAALAYDKAAYRLRGDLARLNFPNLKGSCPGE

SEQ ID NO: 560 - protein, 63 aa, Glycine max
  Glyma18g02170.1 AP2 domain
LYRGVRQRHWGKWVAEIRLPKNRTRLWLGTFDTAEEAALAYDNAAFKLRGENARLNFPHLRHH

SEQ ID NO: 561 - protein, 67 aa, Glycine max
  Glyma14g34590.1 AP2 domain
LYRGVRQRHWGKWVAEIRLPKNRTRLWLGTFDTAEEAALAYDKAAYRLRGDFARLNFPSLKGSCPGE

SEQ ID NO: 562 - protein, 62 aa, Glycine max
  Glyma04g11290.1 AP2 domain
LYRGVRQRHWGKWVAEIRLPKNRTRLWLGTFDTAEEAALAYDKAAYKLRGDFARLNFPNLRH

SEQ ID NO: 563 - protein, 62 aa, Glycine max; identical to SEQ ID NO: 562
  Glyma06g11010.1 AP2 domain

SEQ ID NO: 564 - protein, 63 aa, Populus trichocarpa
  POPTR_0002s09480.1 AP2 domain
LYRGVRQRHWGKWVAEIRLPKNRTRLWLGTFDTAEEAALAYDRAAYKLRGDFARLNFPNLLHQ

SEQ ID NO: 565 - protein, 63 aa, Populus trichocarpa
  POPTR_0005s16690.1 AP2 domain
LYRGVRQRHWGKWVAEIRLPKNRTRLWLGTFDTAEEAALAYDKAAYKLRGDFARLNFPNLRHQ

SEQ ID NO: 566 - protein, 63 aa, Vitis vinifera; identical to SEQ ID NO: 565
  GSVIVT01009007001 AP2 domain

SEQ ID NO: 567 - protein, 63 aa, Solanum lycopersium
  Solyc12g056980.1.1 AP2 domain
LYRGVRQRHWGKWVAEIRLPKNRTRLWLGTFDTAEEAALAYDKAAYKLRGEFARLNFPHLRHN

SEQ ID NO: 568 - protein, 60 aa, Brachypodium distachyon
  Bradi4g29010.1 AP2 domain
LYRGVRQRHWGKWVAEIRLPRNRTRLWLGTFDTAEEAALAYDQAAYRLRGDAARLNFPDN

SEQ ID NO: 569 - protein, 60 aa, Oryza sativa
  LOC_Os08g31580.1 AP2 domain
LYRGVRQRHWGKWVAEIRLPRNRTRLWLGTFDTAEEAALTYDQAAYRLRGDAARLNFPDN

SEQ ID NO: 570 - protein, 61 aa, Zea mays
  GRMZM2G029323_T01 AP2 domain
LYRGVRQRHWGKWVAEIRLPKNRTRLWLGTFDTAEGAALAYDEAAFRLRGDTARLNFPSLR

SEQ ID NO: 571 - protein, 61 aa, Setaria italica
  Si017760m  AP2 domain
LYRGVRQRHWGKWVAEIRLPKNRTRLWLGTFDTAEDAALAYDKAAFRLRGDMARLNFPALR

SEQ ID NO: 572 - protein, 61 aa, Oryza sativa
  LOC_Os02g51670.1 AP2 domain
LYRGVRQRHWGKWVAEIRLPKNRTRLWLGTFDTAEDAALAYDKAAFRLRGDLARLNFPTLR

SEQ ID NO: 573 - protein, 61 aa, Brachypodium distachyon
  Bradi3g58980.1 AP2 domain
LYRGVRQRHWGKWVAEIRLPKNRTRLWLGTFDAAEDAALAYDKAAFRLRGDQARLNFPALR

SEQ ID NO: 574 - protein, 61 aa, Zea mays
  GRMZM5G852704 AP2 domain
LYRGVRQRHWGKWVAEIRLPRNRTRLWLGTFDSAEDAALAYDKAAFRLRGDAARLNFPSLR

SEQ ID NO: 575 - protein, 61 aa, Setaria italica
  Si008385m AP2 domain
LYRGVRQRHWGKWVAEIRLPRNRTRLWLGTFGSAEDAALAYDKAAFRLRGDAARLNFPSLR

SEQ ID NO: 576 - protein, 61 aa, Oryza sativa
  LOC_Os03g09170.1 AP2 domain
LYRGVRQRHWGKWVAEIRLPRNRTRLWLGTFDTAEEAALAYDSAAFRLRGESARLNFPELR

SEQ ID NO: 577 - protein, 61 aa, Zea mays
  GRMZM2G113060 AP2 domain
LYRGVRQRHWGKWVAEIRLPRNRTRLWLGTFDTAEEAALAYDGAAFRLRGDSARLNFPELR

SEQ ID NO: 578 - protein, 64 aa, Arabidopsis thaliana
  AT4G39780 AP2 domain
LYRGVRQRHWGKWVAEIRLPKNRTRLWLGTFDTAEEAAMAYDLAAYKLRGEFARLNFPQFRHED

SEQ ID NO: 579 - protein, 58 aa, Arabidopsis thaliana
  ERF058 clade consensus sequence 1
  misc_feature (9)..(9): Xaa can be Gln or His
  misc_feature (21)..(21): Xaa can be Lys or Arg
  misc_feature (31)..(31): Xaa can be Phe or Tyr
  misc_feature (32)..(32): Xaa can be any naturally occurring amino acid
  misc_feature (33)..(33): Xaa can be Ala, Ser or Thr
  misc_feature (35)..(35): Xaa can be Gln or Glu
  misc_feature (36)..(36): Xaa can be any naturally occurring amino acid
  misc_feature (39)..(39): Xaa can be Met, Ile, Leu, or Val
  misc_feature (40)..(40): Xaa can be Ala or Thr
  misc_feature (43)..(43): Xaa can be any naturally occurring amino acid
  misc_feature (46)..(46): Xaa can be any naturally occurring amino acid
  misc_feature (47)..(47): Xaa can be Lys, Gln or Arg
  misc_feature (48)..(48): Xaa can be Met, Ile, Leu, or Val
  misc_feature (51)..(51): Xaa can be Glu or Asp
  misc_feature (52)..(52): Xaa can be any naturally occurring amino acid
  misc_feature (54)..(54): Xaa can be Lys or Arg
LYRGVRQRXWGKWVAEIRLPXNRTRLWLGTXXXAXXAAXXYDXAAXXXRGXXAXLNFP

SEQ ID NO: 580 - protein, 13 aa, Arabidopsis thaliana
  ERF058 clade consensus sequence 2
  misc_feature (1)..(1): Xaa can be Met, Ile, Leu, or Val
  misc_feature (2)..(3): Xaa can be any naturally occurring amino acid
  misc_feature (4)..(4): Xaa can be Ala or Ser
  misc_feature (5)..(5): Xaa can be Met, Ile, Leu, or Val
  misc_feature (6)..(6): Xaa can be Asn or Asp
  misc_feature (7)..(7): Xaa can be Ala, Ser, or Thr
  misc_feature (9)..(9): Xaa can be Met, Ile, Leu, or Val
  misc_feature (10)..(11): Xaa can be any naturally occurring amino acid
  misc_feature (12)..(12): Xaa can be Met, Ile, Leu, or Val
XXXXXXXKXXXXC

SEQ ID NO: 581 - protein, 15 aa, Arabidopsis thaliana
  ERF058 clade consensus sequence 3
  misc_feature (2)..(4): Xaa can be any naturally occurring amino acid
  misc_feature (7)..(7): Xaa can be any naturally occurring amino acid
  misc_feature (8)..(8): Xaa can be Glu or Asp
  misc_feature (10)..(10): Xaa can be Phe or absent
  misc_feature (11)..(11): Xaa can be Asn or Asp
  misc_feature (13)..(13): Xaa can be any naturally occurring amino acid
  misc_feature (14)..(14): Xaa can be Ala or Ser
  misc_feature (15)..(15): Xaa can be Met, Ile, Leu, or Val
LXXXPSXXIXXWXXX

SEQ ID NO: 582 - DNA, 1356 bp, Zea mays
  GRMZM2G026926_T01
atggacgcgtcaagcgagagcggtggcgcggggggcggtcgtgggggcaggaggtggaagggcaaaggtgtgacgcccatacagccgcggcggacgcagctggcgccggtcatggaggacgcgtcggcggcactgctgcgcccgctcaagaagatcggacgggcgccggaccgcttccagcgctcggcgtcgtcgctgtcgacgacgtcttcgtcggccccgccttcccctcgctccagcgctgctggcgccacctcgccagcgtcgctatcgccgccctcggcgcggcatatgttcccgttcgcgtacgagccctccgcgccgttgggcggggccccgcggctggagctcccgccgccgtggcagcactcccccagcgtgtcacagccggcgtcgccacagcagcagcagcagcagcaggctcaagcgcctgtgcagcgtcagcagcagatgatatcgttcggcgcgccgccccagtaccaggcgcagttcttgttgccggagggcgcgcagcagcagcagcatctgctgcggtactggagcgaggcgctgaacctgagcccgcgcggcgggcaggctgcgggcgtgctgccttcgctgtaccagcacctgctgcggccgccgccgcctcagaagctgtaccgcggcgttcggcagcggcactgggggaagtgggtcgccgagatcaggctgccgcggaaccgcacgcggctctggctcggcacgttcgactccgccgaggacgctgccatggcgtacgatcgcgaggccttcaagctccgcggcgagaacgcgcggctcaacttcccggaccggttctttgggaagggctacgccggggggagcggccgcaccagcgccacacccgcagccgcgccgacagctgccgccgcgtcgggctccacgtcgtcatcgtcgcctccacagactcctgatgacccaagcacgcaacaaacgccgccggacgcagaaagatcgttggacaagcagccacagcctccggttgctacatcgtcgcagctagaaggcagctctggtgagccgaccttggcagattcgggtcaaatgattcactcgccagagccacccgctggcagcgactggggtccggcggacgaggcatggctcaatgcgtggggcccaggaagctccttctgggactacgacattgatagcactcgcggcctctttctccatcacgggcgcttcgccggtgatgaggccggcataaacacagctacaactgcggcggcaaccgggacggacatgccatgcgatcacgtcccggtaacacctgcttcttcttcttcccctcttcactcacagtctcctcattcgccttccttcatggatcac

SEQ ID NO: 583 - protein, 452 aa, Zea mays
  GRMZM2G026926_T01 polypeptide
MDASSESGGAGGGRGGRRWKGKGVTPIQPRRTQLAPVMEDASAALLRPLKKIGRAPDRFQRSASSLSTTSSSAPPSPRSSAAGATSPASLSPPSARHMFPFAYEPSAPLGGAPRLELPPPWQHSPSVSQPASPQQQQQQQAQAPVQRQQQMISFGAPPQYQAQFLLPEGAQQQQHLLRYWSEALNLSPRGGQAAGVLPSLYQHLLRPPPPQKLYRGVRQRHWGKWVAEIRLPRNRTRLWLGTFDSAEDAAMAYDREAFKLRGENARLNFPDRFFGKGYAGGSGRTSATPAAAPTAAAASGSTSSSSPPQTPDDPSTQQTPPDAERSLDKQPQPPVATSSQLEGSSGEPTLADSGQMIHSPEPPAGSDWGPADEAWLNAWGPGSSFWDYDIDSTRGLFLHHGRFAGDEAGINTATTAAATGTDMPCDHVPVTPASSSSPLHSQSPHSPSFMDH

SEQ ID NO: 584 - DNA, 1212 bp, Zea mays
  GRMZM2G040664_T01
atggacgcgtcgagcgagagctgtggcggtggcgcggggggcggtcgtggaggcaggaggtggaagggcaaaggcgccacgcccatccagccgcggcggcagctggcaccggtcatggaggacgcgtcggcggcactgctgcgcccgctcaagaagatcggacgggcgccggaccgcttccagcggtccgcttcgtcgctgtcgacgtcgacgtcttcgtcggccccgccttcgcctcgcgccacctcgccggcgccgcactccgccagcgtgtcacagccggcttcgccgcaggttcaagcgcctatgcagcgccagcagcagatcatatcgttcggcccgccgactcagtaccagacgccgttcttgctgccggagggcgcgcaacagcagcagcatcttctgcggtactggagcgaggcgctgaacctgagcccgcgcggcggccagcaggtcgcgggcgtgctgccttcgcggtaccagcacctgctgcgggctccgccgcctccgcttcagaagctgtaccgtggcgtgcggcaacggcactgggggaagtgggtggccgagatcaggctgccgcgggaccgcacgcggctctggctcggcacgttcgactccgccgaggacgccgccatggcgtacgatcgcgaggcgttcaagctccgcggcgagaacgcacggctcaacttcccggaccggttcttcgggaagggccacgccggggggagcggccgcaccggcgccacatccgcgtcgggctccacatcgtcgtcgtcaactccacagactcctggcgagcaaaacacgcagcaagcgccgccggacgcggaaggatcgtcggacaagcggcctcagcctccggttgcgacatcgtcgcagctacaaggcggctctggtgagacgaccttgccagactccgatcaaatgattcactcaccggaggctcctggcagcgagtggggttcggccgacgaggcatggctcaacgtgtggggcccaggaagctccttctgggactacgacattgagagcacccgcggcctctttcaccatcacgggcgcttcgacggtgatgagaccggcataaacacagcgacaactgcggcggcaaccggggcgggcatgtcatgcgatcatgtcccggtaacacctgcttcttcttcttcctcccctctgcactcacagtctcctccttcacccaccttcatggac

SEQ ID NO: 585 - protein, 404 aa, Zea mays
  GRMZM2G040664_T01 polypeptide
MDASSESCGGGAGGGRGGRRWKGKGATPIQPRRQLAPVMEDASAALLRPLKKIGRAPDRFQRSASSLSTSTSSSAPPSPRATSPAPHSASVSQPASPQVQAPMQRQQQIISFGPPTQYQTPFLLPEGAQQQQHLLRYWSEALNLSPRGGQQVAGVLPSRYQHLLRAPPPPLQKLYRGVRQRHWGKWVAEIRLPRDRTRLWLGTFDSAEDAAMAYDREAFKLRGENARLNFPDRFFGKGHAGGSGRTGATSASGSTSSSSTPQTPGEQNTQQAPPDAEGSSDKRPQPPVATSSQLQGGSGETTLPDSDQMIHSPEAPGSEWGSADEAWLNVWGPGSSFWDYDIESTRGLFHHHGRFDGDETGINTATTAAATGAGMSCDHVPVTPASSSSSPLHSQSPPSPTFMD

SEQ ID NO: 586 - DNA, 1293 bp, Setaria italica
  Si012169m
atggatgcgtcgagcgctagcggcgagagcggcggcggcggtggcgcggggggcggtcgtgggggcaggaggtggaagggcaaaggcggcgtcacgcccatacagccgcggcggcagctggcgccggtcatggaggacgcgtcggcggcgtcgctgcgcccgcacaagaagatcgggcgggcgccggaccgcttccagcggtccgcgtcgtcgctctcgacgacggcttcgtcgtcggccccgccttcccctcgcgccagcgccgcctcgccgacgccggcggagtcgtcgccgccctccgcacggcgcatcttcccgttcgcgtacgagccctcggcgccgccggtgggcggggccccgcggctgcagctcccgccgtggcagcactccagcgcgtcgcaaccggcgtcgccgcagcaggcgccgttgcagcgtcagcagatgatatcgttcggcgcgccgccgcagttccaggcgcagttctttttgccggatggctcgccgcagcaccagcagcagcatctgctgcggtactggagcgaggcgctgaacctgagcccgcgcggcggccaggccgcggccgtgctgccgtcgctgtaccagcacctggtgcgggccccgccgccgccgcagaagctgtaccgcggcgtgcggcagcggcactgggggaagtgggtggccgagatccggctgccgcggaaccgcacgcggctctggctcggcacgttcgactccgccgaggacgccgccatggcgtacgaccgcgaggccttcaagctccgcggcgagaacgcgcggctcaacttcccggaccggttcttcggcaagggccacgccgggggcagcggccgcaccagcgccacctccgcagccgccccgaccactgccgcggggtctggctcctcctcctcctcgtcgcctccacagactccggacgaggcaagcacacaacaaacgccaccgccgcacgcagaaggatcgttggacaagcagccacagcctccggtggcgacatcgtggcagcaagatgtcagctctaaaaccatgccagtctcgggtgaaatgattcacgcgccggtggctcatggcagcgagtggggtccggccgacgaggcttggttcaacgcgtgggggccaggaagttccttctgggactacgacatggacagcaacccaggcctctttctccatggtcgcttcgccggcgatgaggccaccatggagcactccaccgcacaagaaaccacagcggcagcggcagccgggacggacatgtcatgcgatcacgtcccg

SEQ ID NO: 587 - protein, 431 aa, Setaria italica
  Si012169m polypeptide
MDASSASGESGGGGGAGGGRGGRRWKGKGGVTPIQPRRQLAPVMEDASAASLRPHKKIGRAPDRFQRSASSLSTTASSSAPPSPRASAASPTPAESSPPSARRIFPFAYEPSAPPVGGAPRLQLPPWQHSSASQPASPQQAPLQRQQMISFGAPPQFQAQFFLPDGSPQHQQQHLLRYWSEALNLSPRGGQAAAVLPSLYQHLVRAPPPPQKLYRGVRQRHWGKWVAEIRLPRNRTRLWLGTFDSAEDAAMAYDREAFKLRGENARLNFPDRFFGKGHAGGSGRTSATSAAAPTTAAGSGSSSSSSPPQTPDEASTQQTPPPHAEGSLDKQPQPPVATSWQQDVSSKTMPVSGEMIHAPVAHGSEWGPADEAWFNAWGPGSSFWDYDMDSNPGLFLHGRFAGDEATMEHSTAQETTAAAAAGTDMSCDHVP

SEQ ID NO: 588 - DNA, 1398 bp, Oryza sativa
  LOC_Os04g44670.1
atggacgctccgagcggcgagagcggcggcggcggcggcggcggtggtggcaggaggtggaaggggaagggggtgacgcccatacagccgcggcggcagctggggacggttttggaggactcgtcggcggcattgctgcggccgctcaagaagattgggcggagccccgaccgcctcctccgctccgcatcgtcgctctccacgtcctcgtcggctccgccttcgcctcgctcttcttcggcttccgatgctccagtccgcgtcatctcgtcgtcgccgtcgtcgccctcgccaccgtcggcgcgacacatcttccccttcgcgtacgaggcctccacgacgacggtgggtgggagcccaaggctccacccgctgtcgtggcagcaatccagcatgtcccagcccgcgtcgccacagcaacagcagcagcagccgttgcagcaccagcagatgatatcgttcggcgcgtcgcctccgtgctcgacgacgcagttcgtcgtcccggagaacgcgcagcagcagcagatgctgctgcggtactggagcgaggcgctgaacctgagcccgcgcggtggccccggtggcgtgccaccgtggctgtaccagcagctgctccgggtcccgccaccgccgcagaagctttaccgcggcgtgcggcagaggcactgggggaagtgggtcgcggagatccgcctgccacggaaccgcacgcggctgtggcttggcaccttcgacaccgccgaggacgccgccatggcgtacgaccgcgaggccttcaagctccgcggcgagaacgcgcggctcaactttccggaccggttccttgggaagggccgcgccggcgggaaaggccgcaccagcgtaagctcctcggccgctgccgccgcgtcgtgctcgtcgtcgtcgctatcgccaccggagacacctgacgacgcaaacacgcagcaacaagctcctcagcagcgagaacagcgggacacggcaggagtgtccatggagaagaaacaaccacagcctccagctccaacctctcgtcaagaagggtgctctggcggcgacgcagctgcgccgtacccggccgaaatgcttcacgcgccggcggcgtgcggcggcatgtgggttgctcccgacgagtcatggttcagcacgtggggccctggcagctccttctgggacgactacgacatggacagcgctcgcggcctcttcctccaccctcgcttcaccggtgacgaaactagcatggatcattccggcacgcaagcaaccgtgccggcagtggcagcaacagcggcagggatgagcatgccatgcgatgatgttccggtaacctcttcttcttcagatctccctccccaagggacacctcagactcctaccttcatgtggaaggaggac

SEQ ID NO: 589 - protein, 466 aa, Oryza sativa
  LOC_Os04g44670.1 polypeptide
MDAPSGESGGGGGGGGGRRWKGKGVTPIQPRRQLGTVLEDSSAALLRPLKKIGRSPDRLLRSASSLSTSSSAPPSPRSSSASDAPVRVISSSPSSPSPPSARHIFPFAYEASTTTVGGSPRLHPLSWQQSSMSQPASPQQQQQQPLQHQQMISFGASPPCSTTQFVVPENAQQQQMLLRYWSEALNLSPRGGPGGVPPWLYQQLLRVPPPPQKLYRGVRQRHWGKWVAEIRLPRNRTRLWLGTFDTAEDAAMAYDREAFKLRGENARLNFPDRFLGKGRAGGKGRTSVSSSAAAAASCSSSSLSPPETPDDANTQQQAPQQREQRDTAGVSMEKKQPQPPAPTSRQEGCSGGDAAAPYPAEMLHAPAACGGMWVAPDESWFSTWGPGSSFWDDYDMDSARGLFLHPRFTGDETSMDHSGTQATVPAVAATAAGMSMPCDDVPVTSSSSDLPPQGTPQTPTFMWKED

SEQ ID NO: 590 - DNA, 1461 bp, Brachypodium distachyon
  Bradi5g16450.1
atggacgcatcgggcgagagcggcggcggcggtcgtgggagtactgggaggagatcagggaagggcttgacgcccatacaggcgcggcggcagcagcagcagctggcgccggttctggaaaacgcgtcggcggcggcattgctgcgcccgctcaagaagatcgggaggagcccagaccgcctccaccggaccacgtcgacgctctccaccacgtcctcctcctcctcggctcccgcctcgcctcggtcctcctctgtgtccaacgccgccgtctcgccgccttccgcgcgtcacatcttcccctacgcgtacgagccaattatcgcgcctgctgcctcgacaacgacgacgcacgggaggagcccgcggcttgatctccatccctggccgcagtcgtcaaccagcgtatcccagccggcgtcgcctcagcctctgcggcatcagcagatgatatccttcggcgcgtcgtcgcctccgtactgcgcggcgcagtcgttcctggtgccagccgagagcgcgcagcatcagcaccagctgctgcggtactggagcgaggcgctgaacctgagcccccgcggcggcccggccatgccgccgtcgatgtaccagcagttgctgctgcaggcgcctccgccgccaccgccacagaagctgtaccgcggcgtgcggcagcggcactgggggaagtgggtggcggagatccggctgccccggaaccgcacgcggctgtggctcggcaccttcgactccgccgaggacgccgccatggcctatgaccgcgaggccttcaagctccgcggcgagaacgcgcgcctcaacttccccgaccgcttcctcgccaagggccgcgccggtggcagcggccgcaccagcgccagctccgctgctgcttctgcctcgaccgccgccgccgcctcgtgctcctcttcgtcttcgtcgcctccgcaagcttctgacgaggcgccgttcaacacgcagcagcagcagcagcagcaagcagaagggacgacgtcctttgagaaccaattacagcagcatccgcttagtccaacggcgacgaccatccaggaaactacaggcagctctcgtgacgcggctacggcgccgtattcggccgagatgtttcacgcgtcggcggtggcatcatcatccggtggcgccatgtgggctccgcccgacgaggcatggttcaacgcgtggggccccggaagctccttttgggactacgacatggaagacgacggcgcccgcggcctcttcctccaccctcgcttctccggtgacgatgccggcgtggtgcattctggcgcgcaggaaatagcagcagggacgtcgggcacgccgtggccgtgcccatgcgatgacgacgtcccggtaatctcctcttcagctcctcctcctcctcctcctcctcctccccccgagacagctcaggctcctagcctcatgtggaagcaggac

SEQ ID NO: 591 - protein, 487 aa, Brachypodium distachyon
  Bradi5g16450.1 polypeptide
MDASGESGGGGRGSTGRRSGKGLTPIQARRQQQQLAPVLENASAAALLRPLKKIGRSPDRLHRTTSTLSTTSSSSSAPASPRSSSVSNAAVSPPSARHIFPYAYEPIIAPAASTTTTHGRSPRLDLHPWPQSSTSVSQPASPQPLRHQQMISFGASSPPYCAAQSFLVPAESAQHQHQLLRYWSEALNLSPRGGPAMPPSMYQQLLLQAPPPPPPQKLYRGVRQRHWGKWVAEIRLPRNRTRLWLGTFDSAEDAAMAYDREAFKLRGENARLNFPDRFLAKGRAGGSGRTSASSAAASASTAAAASCSSSSSSPPQASDEAPFNTQQQQQQQAEGTTSFENQLQQHPLSPTATTIQETTGSSRDAATAPYSAEMFHASAVASSSGGAMWAPPDEAWFNAWGPGSSFWDYDMEDDGARGLFLHPRFSGDDAGVVHSGAQEIAAGTSGTPWPCPCDDDVPVISSSAPPPPPPPPPPETAQAPSLMWKQD

SEQ ID NO: 592 - DNA, 1347 bp, Zea mays
  GRMZM2G139765_T01
atggagccgatgggcagggacggcggtggaggccacgggaggggctggaaggggaagggcgtgagctcgggctccgccgcggggaggcagctggcgccagttttagaagacgcgccggcggccgcattgctccggcccttgaagaagatccgcagccccgaccggcgcctcaaccgctccctgtccgcgctctcgtcgtcggctcccccttcccctgactcgtcctccgtttccaaccccatgtcgccgccgtcgacgcgacacatatttccgttcgcgtacgatccggctccggcggcatcgacgtccacggctgcgtcgccaaggctcctgccgctgttgcagtacggcagcgtgttccagcagcctctgccgccgcagcagcctttgcagcaccagcagatgatttcgttcggaagcagacagcaacagttcggggcggccgcggctcctctgttcccgccgcagctcgtggcgccgccggaggtgcagcagcaaatgctgctgctgcgctactggagcgaggcgctgaacctgagcccccgggggttccgcgccggggccggggccggggccgtgccgccggcgctgtaccagcagctgctgcgcgcgcccaagctctaccgcggcgtgcggcagcgccactgggggaagtgggtggcggagatccgcctcccgcgcaaccgcacgcgcctgtggctcggcaccttcgacaccgccgaggacgccgccatggcgtacgaccgcgaggccttcaagctccgtggcgagaacgccaagctcaacttccccgacctgttccttggcaagggccgcgtcggcgggagcggccgcaccagtgccagtgcagccgtgtcctgctcctcctcttcgtcgtctgctccgccgacgccggacgagaatcacgcgaagcaagctcagcggcatgacggtgagcagccgtgcaacagcgaagcgaagcctctgttcccggaagcagagcagccaaacaacttggaacacgaaccgaattctcagctccaatcggccgatcaccatggcggtgacggcagcacggtcatgtttcagccgtcggtggcgtcgagcggcatgtggggcccggccgaggaggcgtggttcagcgcctggggcccgggcagctccgtgtgggactacgacatggacaacgcccacggcctcttcctccagtctcgcttcgccagtgaggctgccagcatggactacgtgtccagcatgccggaagccccggcgacaccggcggcagggactgccgtggcctccgctgcttccctttcttctcctccccctcttcctcttccccgcagtccaacctacaggtggaaggac

SEQ ID NO: 593 - protein, 449 aa, Zea mays
  GRMZM2G139765_T01 polypeptide
MEPMGRDGGGGHGRGWKGKGVSSGSAAGRQLAPVLEDAPAAALLRPLKKIRSPDRRLNRSLSALSSSAPPSPDSSSVSNPMSPPSTRHIFPFAYDPAPAASTSTAASPRLLPLLQYGSVFQQPLPPQQPLQHQQMISFGSRQQQFGAAAAPLFPPQLVAPPEVQQQMLLLRYWSEALNLSPRGFRAGAGAGAVPPALYQQLLRAPKLYRGVRQRHWGKWVAEIRLPRNRTRLWLGTFDTAEDAAMAYDREAFKLRGENAKLNFPDLFLGKGRVGGSGRTSASAAVSCSSSSSSAPPTPDENHAKQAQRHDGEQPCNSEAKPLFPEAEQPNNLEHEPNSQLQSADHHGGDGSTVMFQPSVASSGMWGPAEEAWFSAWGPGSSVWDYDMDNAHGLFLQSRFASEAASMDYVSSMPEAPATPAAGTAVASAASLSSPPPLPLPRSPTYRWKD

SEQ ID NO: 594 - DNA, 1380 bp, Setaria italica
  Si019997m
atggagccggcggacaggggcggtggagggcgcgggaggggctggaaggggaagggcgtgagctcgggctccgccgcggggaggcagctggcgccagttttagaagacgcgccggcggccgcattgctccggcccctgaagaagatccgcagccccgaccgccgcctcaaccgctccctgtccgcgctctcgtccgctcccccgtcccccgactcgtcctctgtttccaaccccatgtcgccgccggccacgtcgctgccgtcgacgcgacacatatttccgttcgcgtacgatccggccccggcggcgtcgacagcatcgacagcagcagcggcgacggcaccgaggctcatgccgctgatgcagtactccagcgtgtaccagcagcccctgcccccgcagcaacagcagcctttgcagcaccagcagatgatttccttcggcggcggtcagcatcagcagccgccgccgcagttcgcggcggcggcgagccctctgttcccgccgcagctcgtggcgccggaggtgcagcagcaaatgctgctccgctactggagcgaggcgctgaacctgagcccccgcgggttccgcggcggggccgtgccgccggcgctgttccagcagctgctgcgggcgccgggcccgcccaagctctaccgcggcgtgcggcagcgccactgggggaagtgggtggcggagatccgcctcccgcggaaccgcacgcggctgtggctcggcaccttcgacaccgccgaggacgccgccatggcgtacgaccgcgaggccttcaagctccgcggcgagaacgccaagctcaacttccccgacctgttcctcggcaagggtcgcgtcggcgggagcggccgcaccagcgccagcgcggcggcgtcgtgctcctcctcctcgtcctctgctccgccgacgccggacgacaccaacacgaagcaagcacagcaccatcacggagagcaaccgttcaacagtgaagcgaagcctctgctccccgaaacagagcaggcaaagaactcggaacccgaaccaaatcctcagctccaaccggccgatcatcagggcggtgacggtaacgcggccatgttcaagccgtcggtgacgtccagcggcgggtggggtccggccgacgaggcgtggttcagcgcctggggcccgggcagctccgtctgggactacgacatggacaacgcccacggcctcttcctccagtctcgcttcgccagtgaggtgaccagcatggactacgtgcccagcgccccggatgtcccggtgacaccggcggcagggacagccatggcctctgctgcctccatttctcttccatctcctccacctcctccccgcagtccggcctacatgtggaaggac

SEQ ID NO: 595 - protein, 460 aa, Setaria italica
  Si019997m polypeptide
MEPADRGGGGRGRGWKGKGVSSGSAAGRQLAPVLEDAPAAALLRPLKKIRSPDRRLNRSLSALSSAPPSPDSSSVSNPMSPPATSLPSTRHIFPFAYDPAPAASTASTAAAATAPRLMPLMQYSSVYQQPLPPQQQQPLQHQQMISFGGGQHQQPPPQFAAAASPLFPPQLVAPEVQQQMLLRYWSEALNLSPRGFRGGAVPPALFQQLLRAPGPPKLYRGVRQRHWGKWVAEIRLPRNRTRLWLGTFDTAEDAAMAYDREAFKLRGENAKLNFPDLFLGKGRVGGSGRTSASAAASCSSSSSSAPPTPDDTNTKQAQHHHGEQPFNSEAKPLLPETEQAKNSEPEPNPQLQPADHQGGDGNAAMFKPSVTSSGGWGPADEAWFSAWGPGSSVWDYDMDNAHGLFLQSRFASEVTSMDYVPSAPDVPVTPAAGTAMASAASISLPSPPPPPRSPAYMWKD

SEQ ID NO: 596 - DNA, 1419 bp, Oryza sativa
  LOC_Os02g42585.1
atggacgcggtggacagaggcggaggcggaggcggtggaggagcgcgcgggcacgggcggagatggaaggggaagggagtgagcgcggcgatctcctcctccgcggccgagacgcagcagccggtgccagttttagaagacgcgccggcggccgcagcattgctccgtccccagaagaagatccgcagccccgatcgtcgcctccagcgctccatctcctcgctgtcgtcggcccctgcttcccccgactcgtcctctgtctccaaccccatgtctcccccggcgatgtccttgccgaatcagccgccatcgtcgcgacatatatttccgttcgcgtacgatccgtctccgggcgcggcggcaccaaggctcctcccgctgctgcagtactccagcttgtacccgcagcctctgctgccgcagcagcaatcacccttgcagaatcagcaaatgatatcgttcggcagtagccagcagcagcagcagcagcagccgcagtttggggcggcgtctcctctgttcccgccgcagttcttgccgccggaggagcagcagcgcctgctgctgcgctactggagcgaggcgctgaacctgagccccccaggcgtgcgcggcggcgccctgccgccgtcgctgtaccagcacctgctgcgcgcgcctgggccgcccaaactgtaccgcggcgtgcggcagcgccactgggggaagtgggtggcggagatccgcctgccgcggaaccgcaccaggctgtggctcggcacgttcgacaccgccgaggacgcagccatggcgtacgaccgcgaggccttcaagctccgcggcgagaacgcgcggctcaacttccccgacctcttccttggcaaaggccgcaccggcgggagcggacgcaccagcgccagcgccgcggcctcctgctcctcctcctcctcttcggctccgcctacaccggacgagagccacacgcagcaagctcagccgcagccgcagcagcctacagaagagtcatccaacactgaaccgaagcctctgctcttcgtagcagagcaggacggcattccagaacccgagctgaatcctcagctccagacagctgaacaacatggcagcgacggcaacacggccatgttccagccgtcggtgacgtccggcggcatttggggtccggccgacgaggcgtggttcagcgcttgggggccaggaagctccgtctgggactacgacatggacagcgcccacggcctcctcctccagtctcgcttggccggtgagcagaccggcatggactacgcctacaccgcgccggaagtcctcgtggcaccggtgccggcggcagggacagccatggccactgccgcttcctcctctcttcctcctcgtcctccccctccttgccacagtccaaccttcgcatggaaggac

SEQ ID NO: 597 - protein, 473 aa, Oryza sativa
  LOC_Os02g42585.1 polypeptide
MDAVDRGGGGGGGGARGHGRRWKGKGVSAAISSSAAETQQPVPVLEDAPAAAALLRPQKKIRSPDRRLQRSISSLSSAPASPDSSSVSNPMSPPAMSLPNQPPSSRHIFPFAYDPSPGAAAPRLLPLLQYSSLYPQPLLPQQQSPLQNQQMISFGSSQQQQQQQPQFGAASPLFPPQFLPPEEQQRLLLRYWSEALNLSPPGVRGGALPPSLYQHLLRAPGPPKLYRGVRQRHWGKWVAEIRLPRNRTRLWLGTFDTAEDAAMAYDREAFKLRGENARLNFPDLFLGKGRTGGSGRTSASAAASCSSSSSSAPPTPDESHTQQAQPQPQQPTEESSNTEPKPLLFVAEQDGIPEPELNPQLQTAEQHGSDGNTAMFQPSVTSGGIWGPADEAWFSAWGPGSSVWDYDMDSAHGLLLQSRLAGEQTGMDYAYTAPEVLVAPVPAAGTAMATAASSSLPPRPPPPCHSPTFAWKD

SEQ ID NO: 598 - DNA, 1335 bp, Zea mays
  GRMZM2G300924_T01
atggagccggtgggcggggacggcggtggcggccgcggccgcggccgcgggaggagctggaaggggaagggcgtgagctcgggctccgccgcggggaggcagctggcgccagttttagaagacgcgccggcggccgcattgctccggcccctgaagaagatccgcagcccggaccgccgcctcaaccgctccctgtcctcgctctcgccggctcctccttcccctgactcgtcctctgctttcaaccccacgccgctgccatcggcccgacaaatatttcttgctccggaggcgtcgacagccggatcgccacggctcctgccgctactgcagtactccagcgagttccagcgccctatgacgccgccgccgccggatcagcagcagctccagcagatgatctcgttcggaagcagccagcagccgcgccaagagttcgtggcggcggcggcggcgactcctctgttcccgccgcagctcgtggcgccggaggtgcagcagcaaatgctgctgcgctactggagcgaggcgctgaacctgagcccccgcgggttccgcggcggggccgtgccactgccgccggcgcggctgtaccagcagctgctgctgcgcgcgtcgtcggggccgcccaagctctaccgcggcgtgcggcagcgccactgggggaagtgggtggcggagatccgcctcccgcggaaccgcacgcgcctgtggctcggcaccttcgacacggccgaggacgcggccatggcgtacgaccgcgaggcattcaagctccgcggcgacaacgccaggctcaacttccccgacctgttcctcggcaagggccgcgtcggcgggagcggacgcaccagcgcggcggcctcgtgctcctcgtctgctccgccgacgccggacgacagccacatgaagcaagctgctcagcagcagcagcgtgtgcgtgacggtgagcagccgtgcagcggcgaagcgaagcctctgctcccggaaacggaaacagagcgggcagacaactcggaacccaaaccgaatcctgagctccagtcggccgatcaccaaggcgacggcaccacggccatgtttcagccttcgggcggcgtgtggggtccggccgacgaggcgtggttcagcgcctggggccctggcagctccgtgtgggactacgacatggacaacgcccacggcctcttcctccagtctcgcttcgccagtgaggcgaccagcatggactacgtgcccagcacgccggaagtcccggcagtagggaccgccgtggcctccctttctcctcctcctcctcctccccgcagtccaacctacatgaaggagaaggac

SEQ ID NO: 599 - protein, 445 aa, Zea mays
  GRMZM2G300924_T01 polypeptide
MEPVGGDGGGGRGRGRGRSWKGKGVSSGSAAGRQLAPVLEDAPAAALLRPLKKIRSPDRRLNRSLSSLSPAPPSPDSSSAFNPTPLPSARQIFLAPEASTAGSPRLLPLLQYSSEFQRPMTPPPPDQQQLQQMISFGSSQQPRQEFVAAAAATPLFPPQLVAPEVQQQMLLRYWSEALNLSPRGFRGGAVPLPPARLYQQLLLRASSGPPKLYRGVRQRHWGKWVAEIRLPRNRTRLWLGTFDTAEDAAMAYDREAFKLRGDNARLNFPDLFLGKGRVGGSGRTSAAASCSSSAPPTPDDSHMKQAAQQQQRVRDGEQPCSGEAKPLLPETETERADNSEPKPNPELQSADHQGDGTTAMFQPSGGVWGPADEAWFSAWGPGSSVWDYDMDNAHGLFLQSRFASEATSMDYVPSTPEVPAVGTAVASLSPPPPPPRSPTYMKEKD

SEQ ID NO: 600 - DNA, 1308 bp, Brachypodium distachyon
  Bradi3g49810.1
atggaactggcgccggttttagaagacgcgccaccggccgcattgctccggccactgaagaagcccgattgccgcctccaccgctccgtgtcttcgctgtcgtcggctcctgcttcctctggctcgtcctctgtctccgaccccatctcgccgcctgcggtggggtcctccttgccttatccgtcgccgggatcgacgcggcatatatttccgttcgcgtacgatccgtcccctgcggcggcaccgaggctccttcagctgttgcagtactcctctagcctgtaccaacagcagcctctcctgccgcagcagctccaacagcaacaacaacagacacctttgcagaatcagcagatgatctcgttcggcgacgcccagcacgaggcgcagcagcctcccctgatcccgccgcagctcatggcgccggaagcgctgcgctactggagcgaagcgctgaacctgagcccccggggcgtgctcggcgggctcgtgccggtgccgcagtcgctgttccagcacctgctgcgggcgccggtcccggccaagctgtaccgcggcgtgcggcagcgccactgggggaagtgggtggcggagatccgcctgccgcggaaccgcacgcggctgtggctcggcaccttcgacaccgccgaggacgccgccatggcgtacgaccgcgaggccttcaagctgcgcggcgagaacgcgcgcctcaacttccccgacctcttcctcggcaaaggacgcgccggcgggagcggccgcaccagcgccagcgccgctgcgtcccgctcctcttcctcctgttcgtccgctccgcccacgccggacgagacccgcacgcagcaagctcgtcaggcgctgctgctgcgtgaacagcagcagcagcagcagcaggagcatttggaagagccatcggacattgaaccgacacctctgttctctgcagcagaggagcaggaaggcatcccggaagccgagcaaagtcctcagcttctccataaggcagaacagcaatgcggcgaaggcagcacggccatggcgcaggctccagtgacctccggcggcgtttgggggccggccgacgaggcatggttcagcgcgtggggcccgggcagctccgtctgggactacgacatggacagcgcgcatggtctctttctccagtctcgcttcgccggcgagcagaccggcatggactacgtccccagtgcgccggaagcccacatggcaccggcaccaggggcagcttctccttctctccctcctcgtcctcccccttctcacagtccaaccttcgtgtggaaggac

SEQ ID NO: 601 - protein, 436 aa, Brachypodium distachyon
  Bradi3g49810.1 polypeptide
MELAPVLEDAPPAALLRPLKKPDCRLHRSVSSLSSAPASSGSSSVSDPISPPAVGSSLPYPSPGSTRHIFPFAYDPSPAAAPRLLQLLQYSSSLYQQQPLLPQQLQQQQQQTPLQNQQMISFGDAQHEAQQPPLIPPQLMAPEALRYWSEALNLSPRGVLGGLVPVPQSLFQHLLRAPVPAKLYRGVRQRHWGKWVAEIRLPRNRTRLWLGTFDTAEDAAMAYDREAFKLRGENARLNFPDLFLGKGRAGGSGRTSASAAASRSSSSCSSAPPTPDETRTQQARQALLLREQQQQQQQEHLEEPSDIEPTPLFSAAEEQEGIPEAEQSPQLLHKAEQQCGEGSTAMAQAPVTSGGVWGPADEAWFSAWGPGSSVWDYDMDSAHGLFLQSRFAGEQTGMDYVPSAPEAHMAPAPGAASPSLPPRPPPSHSPTFVWKD

SEQ ID NO: 602 - DNA, 876 bp, Arabidopsis thaliana
  AT4G28140.1
atggactttgacgaggagctaaatctttgtattacgaaaggtaaaaatgttgatcattcttttggaggagaagcttcttccacgtccccaagatctatgaagaaaatgaagagtcctagtcgtcctaaaccctatttccaatcctcttcttctccttattcgttagaggctttccctttttctctcgatccaacacttcagaatcagcaacaacaactcggatcatacgttccggtacttgagcaacgacaagacccgacaatgcaaggccagaagcaaatgatctcctttagtcctcaacaacaacaacagcagcagcagtatatggcccagtactggagtgacacattgaatctgagtccaagaggaagaatgatgatgatgatgagccaagaagctgttcaaccttacatcgcaacgaagctgtacagaggagtgagacaacgtcaatggggaaaatgggtcgcagagatccgtaagccacgaagcagggcacgtctttggcttggtacctttgatacagctgaagaagctgccatggcctacgaccgccaagccttcaaattacgaggccacagcgcaacactgaatttcccggagcattttgtgaataaggaaagcgagctgcatgattcaaactcgtcggatcagaaagaacctgaaacgccacagccaagcgaggttaacttggagagcaaggaactaccggtgattgatgttgggagagaggaaggtatggctgaggcatggtacaatgccattacatcgggatggggtcctgaaagtcctctttgggatgatttggatagttctcatcagttttcatcagaaagctcatcttcttctcctctctcttgtcctatgaggcctttcttt

SEQ ID NO: 603 - protein, 292 aa, Arabidopsis thaliana
  AT4G28140.1 polypeptide
MDFDEELNLCITKGKNVDHSFGGEASSTSPRSMKKMKSPSRPKPYFQSSSSPYSLEAFPFSLDPTLQNQQQQLGSYVPVLEQRQDPTMQGQKQMISFSPQQQQQQQQYMAQYWSDTLNLSPRGRMMMMMSQEAVQPYIATKLYRGVRQRQWGKWVAEIRKPRSRARLWLGTFDTAEEAAMAYDRQAFKLRGHSATLNFPEHFVNKESELHDSNSSDQKEPETPQPSEVNLESKELPVIDVGREEGMAEAWYNAITSGWGPESPLWDDLDSSHQFSSESSSSSPLSCPMRPFF

SEQ ID NO: 604 - DNA, 1008 bp, Arabidopsis thaliana
  AT2G20880.1
atggctactgctaagaacaagggaaaatcaatcagggtccttggtaccagtgaagcagagaaaaaggatgagatggagttggaggaggagttccagtttagtagcggcaagtataaagattcgggtcctggctcggacatgtggttaggagatgcttcctctacgtctccaagaagtcttaggaagactagaacctttgaccgacataatccctatctcgtatcttcttatgctactcctcagccgccaacaacaactacatgctctgtctcttttcccttttacctccctccagcgattcaaaatcaacaacgatttttacacccgaatgacccttcaggacaaagacagcaacaaatgatctcgtttgatcctcaacaacaggtgcaaccatatgttgcacaacagcagcaacaacaacaacatctattgcagtactggagagacattctgaagctgagtccgagcggaagaatgatgatgatgaacatgttaagacaagaaagcgatctgccactgacgaggccaccggttcaacccttcagcgccaccaagctatatagaggtgtcaggcaacgccactggggaaaatgggttgccgagatccgtaagccacgaaacaggacacgtctctggctagggacattcgatacagcagaagaagccgccatggcctacgaccgcgaggccttcaagttgaggggagagaccgctaggctcaatttccctgaactttttctcaataaacaagagccaactcccgtgcatcagaaacaatgtgagacggggactactagtgaagactcaagcagaagaggagaggatgattcgagcacggcattggcagtaggaggggtgagtgaggagacgggttgggctgaggcatggttcaatgcaattccagaggaatggggacctggaagccctctatgggatgattaccactttcccatttctaaccataaggacgatcttgacgccacacaaaactcttcttctgatacaatt

SEQ ID NO: 605 - protein, 336 aa, Arabidopsis thaliana
  AT2G20880.1 polypeptide
MATAKNKGKSIRVLGTSEAEKKDEMELEEEFQFSSGKYKDSGPGSDMWLGDASSTSPRSLRKTRTFDRHNPYLVSSYATPQPPTTTTCSVSFPFYLPPAIQNQQRFLHPNDPSGQRQQQMISFDPQQQVQPYVAQQQQQQQHLLQYWRDILKLSPSGRMMMMNMLRQESDLPLTRPPVQPFSATKLYRGVRQRHWGKWVAEIRKPRNRTRLWLGTFDTAEEAAMAYDREAFKLRGETARLNFPELFLNKQEPTPVHQKQCETGTTSEDSSRRGEDDSSTALAVGGVSEETGWAEAWFNAIPEEWGPGSPLWDDYHFPISNHKDDLDATQNSSSDTI

SEQ ID NO: 606 - DNA, 1065 bp, Glycine max
  Glyma06g45010.1
atggctaacaatagggaaaagtctaccaaggagggtgttgaagagactcatcatcacaaggtgattggtgaaagtgaaggccaagattgggagattgagaaaggaaagggtcttgatttgagctcagggaggagacaatggaagccagtttttgatgatgcttccctgtcacacaggcctctcaagaaaatccgaagccccgaacgcgaaaacccgaatcaacaacaacaacaaccaccatcctctatgctgtctcttcagcctccttcatcaagaatagtgtttccttttgcttttgaaggctctcaacatccaatgccattcccacacccttttggaaccacaaacttgcctctttttcgtccaaatcttcatccaactcaacaaatgatatcttttgggtcccaacagaacatggggtatccaccattcctagccccagaatctaccatgccacaccaacaccaacaacaccttcaacaacatcatcaacagcttcttcattattggagtgatgcaataaatttgagtccaagagggaggatgatgatgatgatgaataggactgaaggaagacaaatgttaaggccacaagcacagcctctgaatgctaccaagctctatagaggagtgaggcaacgccattggggcaaatgggtagccgagattcgtctccctcgcaatcgaactcgcctttggcttggaacctttgacactgctgaagatgctgctatggcttatgatcgcgaagcctttaagcttagaggggaaaatgctaagctcaatttccctgaactctttctcaacaaagataaagcagaacaatccacaactgttgctcctgcttcttcttctaatgaaggttcaacatcaacatcaagccagaacacaaagcaaccagaaccaataccagaagagattaacactgagacagaagagaatgctgaaactggaaaaggaatttcacaacctcaggaattggtttggggtgaatggttcaatgcaattcctgcaggttggggtcctggaagtcctcttccccacgttcacatatcaggacaaaag

SEQ ID NO: 607 - protein, 355 aa, Glycine max
  Glyma06g45010.1 polypeptide
MANNREKSTKEGVEETHHHKVIGESEGQDWEIEKGKGLDLSSGRRQWKPVFDDASLSHRPLKKIRSPERENPNQQQQQPPSSMLSLQPPSSRIVFPFAFEGSQHPMPFPHPFGTTNLPLFRPNLHPTQQMISFGSQQNMGYPPFLAPESTMPHQHQQHLQQHHQQLLHYWSDAINLSPRGRMMMMMNRTEGRQMLRPQAQPLNATKLYRGVRQRHWGKWVAEIRLPRNRTRLWLGTFDTAEDAAMAYDREAFKLRGENAKLNFPELFLNKDKAEQSTTVAPASSSNEGSTSTSSQNTKQPEPIPEEINTETEENAETGKGISQPQELVWGEWFNAIPAGWGPGSPLPHVHISGQK

SEQ ID NO: 608 - DNA, 930 bp, Glycine max
  Glyma12g12270.1
gaagggactcaactcaaggtgattggtgaaagtgaaggccaagattgggagaaagagaagggaaagcgtcttgatttgagctcagggaggagacaatggaagccagtttttgatgatgcttccgtgtcacataggcctctcaagaaaatccgcagccccgaacccgaaaacccgaatcaacaacaacaacaacagccatcctctatgctgtctcttcaacctccttcatcaagaatagtgtttccttttgcttttgaaggctctcaacatccaatgccattcccacacccttttggaaccacaaacttgcctctttttcgtccacctcttcatccaactcaacaaatgatatcttttttgccctcacagaacatggggtatccaccattcctagccccagaatccaccatgccacacgaacaccaacaacaccatcatcaacagcttcttcagtattggagtgatgcactgaatttgagtccaagagggaggatgatgatgatgaataggactgaagggagacaaatgttaaggccccaagcacagcctttgaatgctaccaagctctataggggagtgaggcaacgccattggggcaaatgggtcgctgagattcgtcttcctcgcaatcgaactcgcctttggcttggaacctttgacactgctgaagatgctgctatggcttatgatcgagaggcctttaagcttagaggggaaaatgcaaagctcaatttccctgaactctttctcaacaaggataaagcagaacaatccacaactgctcctgcatcttcttctaatgaagaagggacgactaacactgagagtgaggacatgccaccaacagagacatttgcagtagaaaacgctgaattggtttggggtgaatggttcaatgcaattcctgcaggttggggacctggaagtcct

SEQ ID NO: 609 - protein, 310 aa, Glycine max
  Glyma12g12270.1 polypeptide
EGTQLKVIGESEGQDWEKEKGKRLDLSSGRRQWKPVFDDASVSHRPLKKIRSPEPENPNQQQQQQPSSMLSLQPPSSRIVFPFAFEGSQHPMPFPHPFGTTNLPLFRPPLHPTQQMISFLPSQNMGYPPFLAPESTMPHEHQQHHHQQLLQYWSDALNLSPRGRMMMMNRTEGRQMLRPQAQPLNATKLYRGVRQRHWGKWVAEIRLPRNRTRLWLGTFDTAEDAAMAYDREAFKLRGENAKLNFPELFLNKDKAEQSTTAPASSSNEEGTTNTESEDMPPTETFAVENAELVWGEWFNAIPAGWGPGSP

SEQ ID NO: 610 - DNA, 1218 bp, Glycine max
  Glyma12g33020.1
atggctgcagcgaacagtggcaaattcgatgtgggagatgaaactcacaagaattcacgaaagggtagtgaaagccaagattgggagattgagaagggaaagtgcgtggattgttcaagctctcagaggcgtcaatggaagccagtttttgatgacgtttccatctcatacaatagacccttcaagaaaatccgaagccccgatcgccaaaacacaaaccaatcttcttcttcctcttcttcttcttcttcttcttcttctattccttttcaaccttcacctctctctaatcctccttcaagaatagtgttcccttttgcctttgatggttcccaacagcaccccatgcaattccctcaccaatttggaaccacaaacccacctttccctcacccttctctccaaaaccagcaacaccagatgatatcatttggtgattcttcttcacttctacatcaacatcatcatcatcaacagcagcatcagcagcaccagcagcaacttcttcagtattggagtgacgcgttgaatctaagtccaagaggaatgttaacaagattgggaccagatggaaggccattgtttaggcttccaacacagcccataaacacaacaaaactctatagaggagtgaggcaacgccattgggggaaatgggtcgctgaaatccgtcttccacgaaacagaacgcgtctctggctaggcacatttgacacggccgaagacgccgccatggcctacgaccgagaagccttcaagctacgaggagagaatgctagactcaatttcccagaattgttcctcaacaaggacaaaaaagaagaacaacaacaacaagaacaagaagcttcttcgccagttctttcagctattgcaaagcagcatgaaccttctagtgaacaccgtgacgtccccatagaagagtctaatgagaatgattcgggtgacgccacggtgagcgatgaccaggttcatgctactactgagagttccgaaggagtttctcaggaaatggtttggggagaaatgtctgcatggttcaatgctattcctgctgcttggggtcctggtagtcccatgtgggatgatttggatgccaccaataatcttctttgccaatcacacattcctttttccaatcccaatcaacaagaactcaatgatgctgagagacaagaacaaaacactggaccaggttacttgtggaaggatcaggat

SEQ ID NO: 611 - protein, 406 aa, Glycine max
  Glyma12g33020.1 polypeptide
MAAANSGKFDVGDETHKNSRKGSESQDWEIEKGKCVDCSSSQRRQWKPVFDDVSISYNRPFKKIRSPDRQNTNQSSSSSSSSSSSSSIPFQPSPLSNPPSRIVFPFAFDGSQQHPMQFPHQFGTTNPPFPHPSLQNQQHQMISFGDSSSLLHQHHHHQQQHQQHQQQLLQYWSDALNLSPRGMLTRLGPDGRPLFRLPTQPINTTKLYRGVRQRHWGKWVAEIRLPRNRTRLWLGTFDTAEDAAMAYDREAFKLRGENARLNFPELFLNKDKKEEQQQQEQEASSPVLSAIAKQHEPSSEHRDVPIEESNENDSGDATVSDDQVHATTESSEGVSQEMVWGEMSAWFNAIPAAWGPGSPMWDDLDATNNLLCQSHIPFSNPNQQELNDAERQEQNTGPGYLWKDQD

SEQ ID NO: 612 - DNA, 831 bp, Glycine max
  Glyma13g37450.1
aggcgtcaatggaagccagtttttgatgacgcttccatctcatacaatagacctctcaagaaaatccgcagccccgatcgccaagaaacaaaccaatcttcttcttcttcttcttctactactccttttgaaccttctccactctctaatcctcctccttcctcttcaagaatagtgtttccttttgcttttgatggttcccaacaccccatgcaattccctcaccaatttggaaccacaacaaactcacctttccctcacccatctttccaaaaccagcaacaccagatgatatcatttggcccgagattcttcttcacttgtacatcatcatcatcaacaacaacaacagcatcagcagcaacttcttcagtattggagtggcgcgttgaatctaagccattgtttagtcctccaacacagcgcataaacacaacaaaactctataggggagtgaggcaacgccattggggcaaatgggtcgctgaaatccgtcttccacgaaacagaacgcgtctctggctaggcacatttgacacggccgaagacgccgccatggcctacgaccgcgaagccttcaagcaacgaggagagaatgcaaggctcaatttccccgaattgttcttcaacaaggacaaaaaagaacaaggagaagaagaagcttcttcgccgtctaacgaaaatgactcaggtgacgccaccgtgagcgacgaggttcatgctcctgctgctacagcgagttccgaaggggtttctcaggaactggtttggggagaaatgtctgcatggttcaatgctattcctgctgcttggggtcctggtagtcccatg

SEQ ID NO: 613 - protein, 277 aa, Glycine max
  Glyma13g37450.1 polypeptide
RRQWKPVFDDASISYNRPLKKIRSPDRQETNQSSSSSSSTTPFEPSPLSNPPPSSSRIVFPFAFDGSQHPMQFPHQFGTTTNSPFPHPSFQNQQHQMISFGPRFFFTCTSSSSTTTTASAATSSVLEWRVESKPLFSPPTQRINTTKLYRGVRQRHWGKWVAEIRLPRNRTRLWLGTFDTAEDAAMAYDREAFKQRGENARLNFPELFFNKDKKEQGEEEASSPSNENDSGDATVSDEVHAPAATASSEGVSQELVWGEMSAWFNAIPAAWGPGSPM

SEQ ID NO: 614 - DNA, 1407 bp, Populus trichocarpa
  POPTR_0013s13920.1
atggctgcagctaagaataattttggaaaatccaagaagggtgttgttgatgaaactcgaaagatgatgatggaacaagattggcagcttgatagaggcaaaaaagaagctgatgttagcttcgagaggaggcaatggaaaccggtttttggtgaagcttccttgatggataggcctttgaagaaaatctgtagccctgaacgtcaagaacagatacaatcctctgcatctttagctcatcaattaccatcttgtttctctgtctcttctagctctgcctcgactctgtctctgtatccgccttcttcgtcgccttcacctatgtcatcttcaagttccagacttgtgtttccttttgcctttgaagggtctaatcaacctattcagtgccctcaacaatttagaacaaacccttcattgccaattttccatccactgtctcaagttgcacagaatcaacagcaaatgatttcttttggtcaaaaccagcaacatggcattgcatatcctccgttttatgctggaggattaccaatggctgaccaccaccaccaccaccagcagctgtttcagtactggagtgatgcattgaacttaagtccgagaggaaggatgatgatgatgaacaagctggggccggacggaaggccattgtttaggcctccgattcagcctataaacacaagaaagctttataggggagtgagacaaaggcattggggaaaatgggttgccgagattcgtctccctcgaaataggactcgcctttggctaggcacatttgatactgccgaagatgctgccttagcttatgatcgcgaggccttcaagttaagaggagagaatgctaggctgaatttccctgaacttttcctcaacaaagataaagcaacttccacagctccaagttcaacagtttcttctccgccgacttccaatcaaagtttaaagccaaaacaagcccaagaaggccttaacttgcaggcagaaaccatgtcaccaccaatattaccaccacaaccaccaccagaacaacctccaggagaccatcctgatgatgattccgggatgggttcgagtggggctactgtgagtgatgagattcaggcagtggcagaggggtctagtgcaggggaaggcatttcggggtctcaagaattggagtggggagacatggcagaagcttggtataatgctattcaagcaggttggggtccagggagtcctgtgtgggacgatttggactccactaacaatcttttattacaatctcaccttccttttgttaatccaaatcaacagcagtttaatgattcttgttgtgttctccaagacaacatgggctcagcttcttcttcttcctcctctttcttcccaatgaagtcatactttttgaaggatcaagat

SEQ ID NO: 615 - protein, 469 aa, Populus trichocarpa
  POPTR_0013s13920.1 polypeptide
MAAAKNNFGKSKKGVVDETRKMMMEQDWQLDRGKKEADVSFERRQWKPVFGEASLMDRPLKKICSPERQEQIQSSASLAHQLPSCFSVSSSSASTLSLYPPSSSPSPMSSSSSRLVFPFAFEGSNQPIQCPQQFRTNPSLPIFHPLSQVAQNQQQMISFGQNQQHGIAYPPFYAGGLPMADHHHHHQQLFQYWSDALNLSPRGRMMMMNKLGPDGRPLFRPPIQPINTRKLYRGVRQRHWGKWVAEIRLPRNRTRLWLGTFDTAEDAALAYDREAFKLRGENARLNFPELFLNKDKATSTAPSSTVSSPPTSNQSLKPKQAQEGLNLQAETMSPPILPPQPPPEQPPGDHPDDDSGMGSSGATVSDEIQAVAEGSSAGEGISGSQELEWGDMAEAWYNAIQAGWGPGSPVWDDLDSTNNLLLQSHLPFVNPNQQQFNDSCCVLQDNMGSASSSSSSFFPMKSYFLKDQD

SEQ ID NO: 616 - DNA, 1392 bp, Populus trichocarpa
  POPTR_0019s13330.1
atggattcagctaagaataacactggaaaatccaagaagggtgttgttgatgaaactcaaaggctggcaatggaccaagattggcagcttgatagaggcagaaaagaagctgatattagctttgagaggcggcaatggaagccggtttttggtgaagcttccttgtcagacaggccttccaaaaaaatccgtagccctgaacgtcaagaacaaactcaatcctctgcatatttagctcatcaattgccaccttctttctctgtttcttctagctctgcctctactctgtctttatatccgccttctttgtcgtcttcgcctgtgtcatcttcaagttcaaaacttcagtttccttttgcctttgaagggtctaatcaacctgttcaattccaccaacaagttggaacaaacccttcatcaactatctttcgtccaccatctcaagttgcacagaatcagcagcaaatgatttcttttggtcaaaaccagcaatatggcattgcatatcctccgttttttgctggggaatctgcattggctaaccagcagcagcagcaacagcagctgtttcagtactggaatgacgcattgaacttaagtccgagaggaaggatgatgatgatgaacaggctggggccaaatgggaggccattgtttaggccaccgattcagcctataaatacaacaaagctttataggggagtgaggcaaaggcactggggaaaatgggttgccgagattcgtctccctcgaaatagaactcgcctttggctaggcacatttgacaatgcagaagatgctgccttagcttatgatcgcgaggccttcaagttgagaggagagaatgctaagctgaatttccctgaacttttcctcaacaaagaaaaagaaacttccacagctccaagttcatcagtttcttctccaccaacccccaatcaaagttcaatgccaaaacaagcccaggaaggcattaacttgcaggtggaaaccatgccgccgccgccgccaccagaacagccccaaggagaccatcctgatgatgattccgggttgggttcaagtggggctacggtgagtgatgaggttcaggcagtgggatccagtgcaggggaaggcacttcggggtctcaggaactgatgtggggagacatggcagaagcttggtataatgctattcaagcaggttggggtccagggagtcctgtgtgggacgatttggacaccactaacaattttttattacaatcacaccttccttttgttactccaaatcaacagcagtttactgattcttctgatctccagagacaacaagacaacatgggctcagcttcttcttcttcttcctcttccttccccacgaagccattcttttggaaggatcaagat

SEQ ID NO: 617 - protein, 464 aa, Populus trichocarpa
  POPTR_0019s13330.1 polypeptide
MDSAKNNTGKSKKGVVDETQRLAMDQDWQLDRGRKEADISFERRQWKPVFGEASLSDRPSKKIRSPERQEQTQSSAYLAHQLPPSFSVSSSSASTLSLYPPSLSSSPVSSSSSKLQFPFAFEGSNQPVQFHQQVGTNPSSTIFRPPSQVAQNQQQMISFGQNQQYGIAYPPFFAGESALANQQQQQQQLFQYWNDALNLSPRGRMMMMNRLGPNGRPLFRPPIQPINTTKLYRGVRQRHWGKWVAEIRLPRNRTRLWLGTFDNAEDAALAYDREAFKLRGENAKLNFPELFLNKEKETSTAPSSSVSSPPTPNQSSMPKQAQEGINLQVETMPPPPPPEQPQGDHPDDDSGLGSSGATVSDEVQAVGSSAGEGTSGSQELMWGDMAEAWYNAIQAGWGPGSPVWDDLDTTNNFLLQSHLPFVTPNQQQFTDSSDLQRQQDNMGSASSSSSSSFPTKPFFWKDQD

SEQ ID NO: 618 - DNA, 1398 bp, Citrus clementina
  clementine0.9_009464m
atggctgcagcaaagaacagtagcaaatccgaaaagggcgttgacgaagcaacggaggagatggttagaagccaggattgggagattgatgaaggaaaggattttgatctcagtagcttcgagaggcgacagcaatggaggccagttttagatgaagcttccgtgtctcaaagacctctcaaaaagatccgtagccctgaaagacatcaaaatcctgttaaattttcttcatcttttgattatcaatcaccttctatttcttcggtttctccagcttcagcatcaactcttggctcatcatcttcgagacttgtatttcctttcgcttttgatacatctcaacaagcaattcagtttccacaacaatttccaacgtcgcagttgcagactcctttgccaaattttcacccaccaattcaaccagcacaaactcagcaacaaatgatctcttttagcgctcaccagcagcagcagggctttccctttttcgctggagaatccatgctgcctcatcagcagcaccagcggcagcttcttcagtattggagtgatgcattgaacttgagcccacgaggaaggttgatgatgaatagaattggaccagatgggaggccattatttaggcctcaagtgcagcctttaaacactacaaagctttacaggggagtgagacagagacattggggcaaatgggtagccgaaattcgtctccctcgcaataggactcgcctttggcttggaacatttgacagggctgaagatgccgccttagcctatgaccgcgaggcctttaaattgagaggagagaatgctaggctcaatttccccgaattgtttctcaataaagataaagcagcagtgtccaccgatcctggttcaaatatttcatcgccaccatctccttatgagagttcaatgccaaatcgattgcagactcaacatgctcaaaacagtctaaattcccaagtcatgagctcagaaccaataccagctccgccaccacagcctaaagtagaaattcctgacagtgagtcaggtttagggtccagtgaggctactgcgagtgatgacgtgctggcagctgctgagggttctggttcaggagaaggggtttcaggttcacaagaattagcctggggtgaaatggcagaggcttggttcaatgcaattccagcaggttggggtccaggtagtcctgtgtgggatgattttgacagctctaacaatcttctcatgccagcaaatcttccatttgtcaaccaaagtcagcaagagttccctgattctgatcgtcagaggcagcatgacaattcagtttctgctgcttcttcaacttcacctccttgtcctatgaaacccttcttttggaaggatcaagatcacccacaagattcatct

SEQ ID NO: 619 - protein, 466 aa, Citrus clementina
  clementine0.9_009464m polypeptide
MAAAKNSSKSEKGVDEATEEMVRSQDWEIDEGKDFDLSSFERRQQWRPVLDEASVSQRPLKKIRSPERHQNPVKFSSSFDYQSPSISSVSPASASTLGSSSSRLVFPFAFDTSQQAIQFPQQFPTSQLQTPLPNFHPPIQPAQTQQQMISFSAHQQQQGFPFFAGESMLPHQQHQRQLLQYWSDALNLSPRGRLMMNRIGPDGRPLFRPQVQPLNTTKLYRGVRQRHWGKWVAEIRLPRNRTRLWLGTFDRAEDAALAYDREAFKLRGENARLNFPELFLNKDKAAVSTDPGSNISSPPSPYESSMPNRLQTQHAQNSLNSQVMSSEPIPAPPPQPKVEIPDSESGLGSSEATASDDVLAAAEGSGSGEGVSGSQELAWGEMAEAWFNAIPAGWGPGSPVWDDFDSSNNLLMPANLPFVNQSQQEFPDSDRQRQHDNSVSAASSTSPPCPMKPFFWKDQDHPQDSS

SEQ ID NO: 620 - DNA, 1428 bp, Eucalyptus grandis
  Eucgr.K00961.1
atggctgcggcgaagaacaccgggaaatcgagaaggggcgttgatgagagccagaagatgacggagttggagacgggcaagggagactatgagttcagcttggatagccagcagtggaggcctgtgtttggagaagcttccatgtcgggtaggcctctcaagaagatccggagcccggagaggcaagcgagcttccagttatcatcgtcttcttccacgcatcagaatcaaacacctttcgccatgccttcctctgttcctcctacctcagcctcgtcggtcggtcactctcccatggctccttcgtcttcgcacaactctccgagattgatctttccttttgctctggagggagcccaacatcacgggcagttccagcaacagctcgggaccgtgccgtatcacgcgtttcggccggcgctccagctccaacctccgcaaaaccaggggcagcagcagcagcagcagcagatgatatctttcacctcgcaacagcagcagcagcagcagcagcagctaagccttaatcagccgctgtataatttcgcaggtgacttgtccccattgcagcacccccagcagaggctgctgcagtactggagtgacgcgctgaatctcagcccgagggggaggatgatgatgatgaatcggttggggcccgacggcaggccgatcttccggcctccgcagccgataaacaccacgaagctctatcgtggagtgaggcagcggcattggggcaagtgggttgcagagattcgcttgccgaggaaccgaacccgactctggctcggaaccttcgacacagccgaggatgcagccctggcctatgaccgcgaggcgttcaagctacgaggggagaatgccaggctcaatttccccgagcttttcctcaacaaggacaaggctgaggaatccgctggtccaagctcgtcatcttcgtcaccccccaaggatgaaaacgtgatcactcgccaatacatgaagacttctccgcaagcttcagaagatcccacccagcaggactcgtccatggagctgatgacctcgccgcctcaggaaaccaatcccgatggggattcgggaataggatcgagcgaggccacggcaagtgaagcggttcaaggggtggcaggaagtagcattgcaggggaaggaggctcggtctcgcaggagatggtgtggagggaaatggcggaggcttggtgcaatgcgatgccggccggctggggaccgggcagtccagtatgggatgatttggatgcaagcagcaatattctgctgccatcacaccttcctttcggccatgggaacgagcaggagttcgacgagaataatgtccggaggcagcaggaaaatttctgtgccgcttcatcatcgtcgtcaagctcttgccctatgaaacccttcttttggaaggatcaagat

SEQ ID NO: 621 - protein, 476 aa, Eucalyptus grandis
  Eucgr.K00961.1 polypeptide
MAAAKNTGKSRRGVDESQKMTELETGKGDYEFSLDSQQWRPVFGEASMSGRPLKKIRSPERQASFQLSSSSSTHQNQTPFAMPSSVPPTSASSVGHSPMAPSSSHNSPRLIFPFALEGAQHHGQFQQQLGTVPYHAFRPALQLQPPQNQGQQQQQQQMISFTSQQQQQQQQQLSLNQPLYNFAGDLSPLQHPQQRLLQYWSDALNLSPRGRMMMMNRLGPDGRPIFRPPQPINTTKLYRGVRQRHWGKWVAEIRLPRNRTRLWLGTFDTAEDAALAYDREAFKLRGENARLNFPELFLNKDKAEESAGPSSSSSSPPKDENVITRQYMKTSPQASEDPTQQDSSMELMTSPPQETNPDGDSGIGSSEATASEAVQGVAGSSIAGEGGSVSQEMVWREMAEAWCNAMPAGWGPGSPVWDDLDASSNILLPSHLPFGHGNEQEFDENNVRRQQENFCAASSSSSSSCPMKPFFWKDQD

SEQ ID NO: 622 - DNA, 1170 bp, Solanum lycopersicum
  Solyc07g054220.1.1
atggcgacaccaccagaggaaccaatggagtttgatgataatacttttgaaagacaacaaaggaggccagtttttgaagaagcttccatgtctaataggcgtttcaaaaaaatcaaaagtccagaacgtcaatcctctgttcaacaaccgtttgatcatcgtaataatccgacgccaatggcgtttcctccacctccgtcatcgtcaaggcttgttttcccttttgcctttgacggtacgcagcagtccatggaaagttcgtcaccattgggagcgaacgcgatgcctctgtttcatccacagcagcaaaatcagcagcaaatgatatctttttcgcctcaacagtgtctttaccctccgtattttgcaggggagttagggccatcgcagaatcagcagcagatgttgaggtattggaatgagacgcttaatttaagtccgagaggaagaatgatgatgatgagcagattggggcaggataacaggggatattttaggcctcaacaggtgcaagtacagccaatttccgctacgaagctatacagaggagtgaggcagagacattgggggaaatgggtagctgaaattcgtcttcctcgtaataggactcgtctttggcttggtacttttgatacagctgaagatgcagctatggcttatgaccgcgaggcgtataagctaagaggagacaatgctaagctcaatttccccgaacactttattggtaaagacagaggagagacatctacagaggctaattcgtcttcaattactactcatgaatcttccttgcctgaacacaattctgaaagtttacaattacagactgtaaataacgaacaactgcctccgtcaccgcccccacagccaccaccagaaggtgataaccatgacgaggactcggggataggatcgagtcaggtgactactaattcacaatcatctgagttagtatggggtgatatggcggaggcttggttcaatgcaactggttggggtccaggtagcccagtttgggatgatttagacacaaataacaacctcatgttttcacctaatcttcattttgggaatttcagtcaacaagagcctcatgattctgatcctcatcaacatcatgacacgaatagcgatccatcttcgccttcatgtcctatgaggccgttcttt

SEQ ID NO: 623 - protein, 390 aa, Solanum lycopersicum
  Solyc07g054220.1.1 polypeptide
MATPPEEPMEFDDNTFERQQRRPVFEEASMSNRRFKKIKSPERQSSVQQPFDHRNNPTPMAFPPPPSSSRLVFPFAFDGTQQSMESSSPLGANAMPLFHPQQQNQQQMISFSPQQCLYPPYFAGELGPSQNQQQMLRYWNETLNLSPRGRMMMMSRLGQDNRGYFRPQQVQVQPISATKLYRGVRQRHWGKWVAEIRLPRNRTRLWLGTFDTAEDAAMAYDREAYKLRGDNAKLNFPEHFIGKDRGETSTEANSSSITTHESSLPEHNSESLQLQTVNNEQLPPSPPPQPPPEGDNHDEDSGIGSSQVTTNSQSSELVWGDMAEAWFNATGWGPGSPVWDDLDTNNNLMFSPNLHFGNFSQQEPHDSDPHQHHDTNSDPSSPSCPMRPFF

SEQ ID NO: 624 - DNA, 1119 bp, Arabidopsis thaliana
  SPATULA AT4G36930 or G590)
atgatatcacagagagaagaaagagaagagaagaagcagagagtgatgggagataagaaattgatttcatcttcttcttcttcctcggtttacgatactcgtatcaatcatcatcttcatcatcctccgtcttcttccgacgaaatctctcagtttctccggcatattttcgaccgttcttctcctttaccttcttactactccccggcgacgactacaacgacggcgtctttgattggtgtgcacgggagcggtgacccacatgcagataactcgagaagtctcgtttctcatcatccaccgtcagattctgtgcttatgtcgaaacgtgtcggagatttctctgaggttttaatcggcggaggatcaggctcagccgccgcgtgttttggtttctccggtggtggtaataataacaacgttcaaggaaatagctctgggactcgagtatcgtcttcttccgttggagctagtggcaacgagacagatgagtatgactgtgaaagcgaggaaggaggagaagctgtagttgatgaagctccctcttccaagtcaggtccttcttctcgtagttcatctaaaagatgcagagctgctgaagttcataatctctctgagaagaggaggagaagtagaattaatgaaaaaatgaaagctttacaaagtctcatccctaattcaaataagacggataaggcttcaatgcttgatgaagccattgagtatctgaaacagcttcagctccaagttcagatgttgactatgagaaatggaataaacttgcatcctttgtgtttacctggaactacattacacccattgcaactctctcagattcgaccccctgaagcaaccaatgatcctctgcttaatcataccaatcagtttgcttcgacttctaatgcaccggaaatgatcaatactgtggcttcttcatacgctttggaaccttctattcgcagtcactttggacctttccctctccttacttcacccgtggagatgagtcgggaaggtgggttaactcatccaaggttgaacattggtcattccaacgcaaacataaccggggaacaagctctgtttgatggacaacctgacctaaaagatcgaattact

SEQ ID NO: 625 - protein, 373 aa, Arabidopsis thaliana
  SPATULA AT4G36930 polypeptide
MISQREEREEKKQRVMGDKKLISSSSSSSVYDTRINHHLHHPPSSSDEISQFLRHIFDRSSPLPSYYSPATTTTTASLIGVHGSGDPHADNSRSLVSHHPPSDSVLMSKRVGDFSEVLIGGGSGSAAACFGFSGGGNNNNVQGNSSGTRVSSSSVGASGNETDEYDCESEEGGEAVVDEAPSSKSGPSSRSSSKRCRAAEVHNLSEKRRRSRINEKMKALQSLIPNSNKTDKASMLDEAIEYLKQLQLQVQMLTMRNGINLHPLCLPGTTLHPLQLSQIRPPEATNDPLLNHTNQFASTSNAPEMINTVASSYALEPSIRSHFGPFPLLTSPVEMSREGGLTHPRLNIGHSNANITGEQALFDGQPDLKDRIT

SEQ ID NO: 626 - DNA, 993 bp, Brachypodium distachyon
  Bradi1g48400.1
atggaggacttcgaagggggccgcggggcggtgcgggagctggtgctgatgcagcaggagcggcggcggcggcgggaggaggaggaggacgagctgcggcgccagatgttcggccccgtcgtcggcggggcggcggcgttccactccgcgtcagcgctggcccagcaccaccaccagcagcagcagcagcaggcggcggcggccgactgcggggagctgggtggcgggttctacgagagcgaggcgggcgggtcgtcggagcccgagccgcactcgtccgagcggccccgcgggggctccggcagcaagcgcacccgcgccgccgaggtgcacaacctctccgaaaagaggagaaggagcaggatcaacgagaagatgaaggcgttgcagagcctgataccgaattccaacaagaccgacaaggcgtccatgcttgacgaggccattgagtacctgaagcagctgcagctccaagtgcagatgttgtctatgagaaatggggtttacttgaacccatcttatttatctggagcacttgagcctatgcaagcatcgcaaatgttcgcagcactcggcgttggtggcagaaatgtgacagcagcaaaccccgggggagtagtgccacctgtaaaccaaaatacaggagctcaccactcatttgatccaatgaattcccctccacaaaatcagcaaccacctctagtgttgccaagctgtcctaacgcaaccatcccagagccttcgtttcacttggggacgtcacagtcccaccttcgaccatttcaattgcctgagtcctctgagatggtatttcgaggggagataatgccaaagcatcaaataacattagctcaagatagagctaatctgccaggaaacaagatggactccgtcaggcaagaacctcccatgtcgaacactgatcattttgatggatgctcacgcagcaaagagcacccacaggatattataccaactaatacaagacatgcg

SEQ ID NO: 627 - protein, 331 aa, Brachypodium distachyon
  Bradi1g48400.1 polypeptide
MEDFEGGRGAVRELVLMQQERRRRREEEEDELRRQMFGPVVGGAAAFHSASALAQHHHQQQQQQAAAADCGELGGGFYESEAGGSSEPEPHSSERPRGGSGSKRTRAAEVHNLSEKRRRSRINEKMKALQSLIPNSNKTDKASMLDEAIEYLKQLQLQVQMLSMRNGVYLNPSYLSGALEPMQASQMFAALGVGGRNVTAANPGGVVPPVNQNTGAHHSFDPMNSPPQNQQPPLVLPSCPNATIPEPSFHLGTSQSHLRPFQLPESSEMVFRGEIMPKHQITLAQDRANLPGNKMDSVRQEPPMSNTDHFDGCSRSKEHPQDIIPTNTRHA

SEQ ID NO: 628 - DNA, 664 bp, Glycine max
  Glyma01g39450.1
atgtaccactttgacaagaacctctcttcgcaagacgaaatctcactttttctgcgtcagattctgctccgttcatcaccaccttcttcttcttcatcttcccgccccatgcctactgtatcctgcacctctaacgttgctcaccaaaacgtaaatgcacacccttctttcacagcgtcgcagctccaagatgggaagatcttggcccttgattccaccgcttcttttgcctcgggttctgccgcttgcagccccttcaagggccagggtgcttctgctgcaaatgtgtcttcttcgtctgctggagtgagtgagaacgaaaatgatgactatgattgtgaaagtgaggagggtgttgaggctttggccgaagaagttccaacaaaggctgcttcttctaggagttcatctaaaagatcaagagctgctgaagttcataatttgtctgagaagcgaagaaggagtaggatcaacgagaaaatgaaggctttgcaaaacctaattccaaattctaacaagacagataaggcttcaatgctcgatgaagctattgaataccttaaacagcttcagctccaagtacagatgctgtcaatgagaaatgggttgagtttgcatcctatgtgctttcctgatggcttgcagcctctgcagttgtctcaga

SEQ ID NO: 629 - protein, 222 aa, Glycine max
  Glyma01g39450.1 polypeptide
MYHFDKNLSSQDEISLFLRQILLRSSPPSSSSSSRPMPTVSCTSNVAHQNVNAHPSFTASQLQDGKILALDSTASFASGSAACSPFKGQGASAANVSSSSAGVSENENDDYDCESEEGVEALAEEVPTKAASSRSSSKRSRAAEVHNLSEKRRRSRINEKMKALQNLIPNSNKTDKASMLDEAIEYLKQLQLQVQMLSMRNGLSLHPMCFPDGLQPLQLSQM

SEQ ID NO: 630 - DNA, 930 bp, Populus trichocarpa
  POPTR_0014s02590.1
atggaggatctgtacggagcggcagcggctactgagccggaagaaatctcgactttccttcatcaactcctccacaacaactcttcttccccttctaaattcatgcatcatgccctctctaccccagtggagaatggcgtggaattgttagatcgccaccggttttctgagacggagtgtggtgctggtgttaatttctctgatcctgatggttattatgctaaagaaggcgtgggaaatgcggtcgtttcaaagaggggaggagtctctgtggaggatgatctaggtgattttagctgcgatagtgagaagggggtggaggtgcaagctaatacagcgcggccgcgaagttcgtcgaagaggagtagagctgcggaggttcataatttatctgaaaagaggaggaggagcaggatcaatgagaaaatgaaagcattacagaatttaattcctaattctaataagacggataaggcttcgatgctggatgaggccattgaatacttgaagcagcttcagcttcaagtgcagatgctaacaatgagaaatggattgagtttgcacccgatgtgcttaccaggagcactacagccaatgcagctgcccttgtcaggaatgagctttgatgaagggattggattgttaactaccaatacattaacaggcatattttctgcaaatgaagaaagctcagagcaaaattctcttaatcttccaacccagtgcactatctcaaatcaaccaatcactattccttcagggacaaatattacctcatcagaaaccaacttcggttttgaaccacagatccatgttaaccatgcacctttcaatctgtccacgtcttcaaaggaaatctgcagggaaggcacaccacaggcaaagctagagatgaatcaaactacgaagacctccccatctggtgtggcc

SEQ ID NO: 631 - protein, 310 aa, Populus trichocarpa
  POPTR_0014s02590.1 polypeptide
MEDLYGAAAATEPEEISTFLHQLLHNNSSSPSKFMHHALSTPVENGVELLDRHRFSETECGAGVNFSDPDGYYAKEGVGNAVVSKRGGVSVEDDLGDFSCDSEKGVEVQANTARPRSSSKRSRAAEVHNLSEKRRRSRINEKMKALQNLIPNSNKTDKASMLDEAIEYLKQLQLQVQMLTMRNGLSLHPMCLPGALQPMQLPLSGMSFDEGIGLLTTNTLTGIFSANEESSEQNSLNLPTQCTISNQPITIPSGTNITSSETNFGFEPQIHVNHAPFNLSTSSKEICREGTPQAKLEMNQTTKTSPSGVA

SEQ ID NO: 632 - DNA, 1134 bp, Solanum lycopersicum
  Solyc02g093280.2.1
atggccaacaacaatgtttattatcacaatgctaatttttctttgactgatcctgatcctgaaccagatgatatttctgtgtttcttcgtcatattctacttccttcttcgtcttcgtcttcatcttcatctaattttatggccctgaagagtaatgaaatgcaatattcctcatcattacctcatcttatgcctaataataatcaacagggtaatttgtcatccatgatgaattcatcagcttgcggcattttctcgtcttcctatggggtttgtaatggtgcaactactgtttcttcctcatctgttgggaccatagattacgatccggatgagtatgaatgtgaaagtgaggatggtacagaggatttgggggcggaagcttcagttcaaccgccatctcgtaacacttccaagagaagcagagcagctgaagtgcacaatttgtctgaaaagaggagaagaagcaggattaatgagaagatgaaagcattgcaaaaacttattccaaattcaaataagactgacaaggcttcaatgcttgatgaagccattgagtatcttaagcagcttcagctccaagtacagatgttgacaatgagaaacgggttaaacatgtatcctcttggcctgccacgaatgctacaacaaaatcaactctcccatcaaaaagtaggtttgtgcgaggggaatgcattcacaaatgccaaagtggctgggaatctacaagttaaccaagacgcctcgttaaatgctattttcaacccaactgaaaattgtacagaaactaaggtaacaccaccgataactatgtcaaatataaaccggtcagacagtgcgtttgagcttgagtcatcgatgaatattcaccttgatccctttcagctctcaagatctaccagcaaggaaatttggagggaggatgacttacctttatatggtatgaatgagctaacgaccaaaactgcatcaactggatcaaatctggcattctcagttcccctagatacggatgcatctaacctgaagagaagcactcgggaggcctgcttgcttcgatatcagtttggtgctgtgaatgaaaccaatctggattgtgaccaacttctttcccaacaactgtatagcaacttc

SEQ ID NO: 633 - protein, 378 aa, Solanum lycopersicum
  Solyc02g093280.2.1 polypeptide
MANNNVYYHNANFSLTDPDPEPDDISVFLRHILLPSSSSSSSSSNFMALKSNEMQYSSSLPHLMPNNNQQGNLSSMMNSSACGIFSSSYGVCNGATTVSSSSVGTIDYDPDEYECESEDGTEDLGAEASVQPPSRNTSKRSRAAEVHNLSEKRRRSRINEKMKALQKLIPNSNKTDKASMLDEAIEYLKQLQLQVQMLTMRNGLNMYPLGLPRMLQQNQLSHQKVGLCEGNAFTNAKVAGNLQVNQDASLNAIFNPTENCTETKVTPPITMSNINRSDSAFELESSMNIHLDPFQLSRSTSKEIWREDDLPLYGMNELTTKTASTGSNLAFSVPLDTDASNLKRSTREACLLRYQFGAVNETNLDCDQLLSQQLYSNF

SEQ ID NO: 634 - DNA, 540 bp, Eucalyptus grandis
  Eucgr.I00906.1
ggactcgaagcgttgctggaggacgttcctgccaggccaaatccgcctcgtggctcgtccaagcgaagtaggacagctgaagttcataatttgtcagaaaagaggaggaggagcaggatcaatgagaaaatgaaagcattgcaaagtctaattcctaattctaacaagactgacaaggcatcaatgctggatgaagccattgagtaccttaagcagctccagctccaagttcagatgttatcgataaggaacggattaagtttgcatccgatgtgcttacccggggccatgcaacccattcaacttccccagatgagaatgggctttgatgaggaaaatgcacctctgcatatgaacatggcacctacttttccagtcaacaatgaaacctcaacagaaaatgtgtttggtctacccaatgatcgtgctgttccaagcgagccttccatgtcaaatatgatgaattcagaaatttcttttggattggaatcgtccattcaaactcatcgtgtaccatttcaaatcaagcaattgacttct

SEQ ID NO: 635 - protein, 181 aa, Eucalyptus grandis
  Eucgr.I00906.1 polypeptide
GLEALLEDVPARPNPPRGSSKRSRTAEVHNLSEKRRRSRINEKMKALQSLIPNSNKTDKASMLDEAIEYLKQLQLQVQMLSIRNGLSLHPMCLPGAMQPIQLPQMRMGFDEENAPLHMNMAPTFPVNNETSTENVFGLPNDRAVPSEPSMSNMMNSEISFGLESSIQTHRVPFQIKQLTSR

SEQ ID NO: 636 - DNA, 1182 bp, Vitis vinifera
  GSVIVT01022111001
atggcggatcagtacaccaagccttgctcttcttctcctgtgccaccgtcatccgcttcggaaccggacgaaatatctctctttctccaccagattcttttccggtcgtcgtcgtcgtcgtcaaccacttcgcttcacaatgccaaacttatgccgagcgagtttctgtcggagaatcctctcagacagtgtcgatcccctcttatttccagctcggatcgcctcgttcgggacggaatgaactcctccaccggcgtttattttcccgtgagtgccggaactgcgtcttcgtcggctggaggcttcgacaatgacctggacgagtacgactgcgagagtgaggaaggtcttgaagcattggtggaagaggtggcgacaaaggcagctcctctgcgaagttcgtcgaagagaagcagggctgccgaggtccataatttgtctgaaaagaggaggaggagtaggattaacgagaaaatgaaagcgttgcagaatctaattccaaattctaacaagacagacaaggcttccatgcttgatgaggccatcgaatacctcaagcagcttcagcttcaagtacagatgttatcaatgagaaatgggttaagtttgcatcctatgtgtctacctggagtactgccgcctgtccaactttcccagatgagaataggcattggagaggaaaatggatccctgcatatggacatgactggcacacttcctgtgaaccaagaaaccatggaatacaggctagccaaccaaggcacctcctcaagtcatccatcggtccccaacttgacagatataatgaattcagaaacttcatttggattggaatcatcaatccaggctcaccttggaccttttcagctccaaacatcctctgcggatatctgcagggaagacgtgttgcctcatcagcagttaaacataagttgtgcaggaacaaattcattagaattaaaaatggaaaccacaattacagtgtcactaccctatgatgcacaagcttctggtgtgaaagacagcaacactctggaatcgtgcatccaaagaagagatctgtctgaaggcatgctcctaaagaacattgaacacaaccaagttccttttccccaattgaatggcatgcatacgggtagaagtgttcccaatgatgacatgaagacagataggcttgatttt

SEQ ID NO: 637 - protein, 394 aa, Vitis vinifera
  GSVIVT01022111001 polypeptide
MADQYTKPCSSSPVPPSSASEPDEISLFLHQILFRSSSSSSTTSLHNAKLMPSEFLSENPLRQCRSPLISSSDRLVRDGMNSSTGVYFPVSAGTASSSAGGFDNDLDEYDCESEEGLEALVEEVATKAAPLRSSSKRSRAAEVHNLSEKRRRSRINEKMKALQNLIPNSNKTDKASMLDEAIEYLKQLQLQVQMLSMRNGLSLHPMCLPGVLPPVQLSQMRIGIGEENGSLHMDMTGTLPVNQETMEYRLANQGTSSSHPSVPNLTDIMNSETSFGLESSIQAHLGPFQLQTSSADICREDVLPHQQLNISCAGTNSLELKMETTITVSLPYDAQASGVKDSNTLESCIQRRDLSEGMLLKNIEHNQVPFPQLNGMHTGRSVPNDDMKTDRLDF

SEQ ID NO: 638 - DNA, 1107 bp, Vitis vinifera
  GSVIVT01009467001
atggcggatctgtatggaacaaacgtttcttcttctgccaccgctctcgctctcgaatcagaagatatctctgcgtttcttcaccacttcctccataatcagtcttcttcttctactactactagtactattaaggctaagcacgcgcactccttttcgcctgcgctactacatccggagacggcatccgccgccgaagtgttgtctccacagaaggatcggcgccggttctctcgatcggcgattctttccgactccgactgccgagttaggagcggactctctacggctggatcatctgccgtggttgaatcctccaccggcattaacttctcagatcacggggcctattgccctgcgggtatgaaggagactgctgggaacactttcagttctattgctgctgtggattctgaggcgatcacggtttccaggaagagaagaatgttttccatggagaatagcgtggacgactttggttgtgatagcgagaagggtcctgaagcatcggatgtgccctcgaatccagccccgtctcggtcttcttcaaagaggagcagagcagctgaggtccataatttgtcagaaaagagaaggaggagcaggataaatgaaaaaatgaaagccttgcagaatttaattcctaattctaataagacggataaggcttcaatgttggatgaagccatcgaatacctgaagcagcttcagctccaagttcagatgctaacaatgagaaatggattaagtttacatccaatctacttaccaggagcactgcagcctacgcagctgccccaaacgggagcaggttttgctgagggaaatctattgcttagcaacagtggaactggcacacttcctgctaatcaagaaatctcaatgcaaactacatttgatcttaccagccaaccaattgccatacccacgatgacaaacatgaacaattcagatacctcgtttggttttgaacattcggatcagcctcattatggacccttcaatctcacaggatcatccaaggaaatctgccacgaagaggcattaccagaacctcaaggagagatgaactgctccaggaaaaactcatcatctggtgtgtcttcc

SEQ ID NO: 639 - protein, 369 aa, Vitis vinifera
  GSVIVT01009467001 polypeptide
MADLYGTNVSSSATALALESEDISAFLHHFLHNQSSSSTTTSTIKAKHAHSFSPALLHPETASAAEVLSPQKDRRRFSRSAILSDSDCRVRSGLSTAGSSAVVESSTGINFSDHGAYCPAGMKETAGNTFSSIAAVDSEAITVSRKRRMFSMENSVDDFGCDSEKGPEASDVPSNPAPSRSSSKRSRAAEVHNLSEKRRRSRINEKMKALQNLIPNSNKTDKASMLDEAIEYLKQLQLQVQMLTMRNGLSLHPIYLPGALQPTQLPQTGAGFAEGNLLLSNSGTGTLPANQEISMQTTFDLTSQPIAIPTMTNMNNSDTSFGFEHSDQPHYGPFNLTGSSKEICHEEALPEPQGEMNCSRKNSSSGVSS

SEQ ID NO: 640 - DNA, 948 bp, Citrus clementina
  clementine0.9_029807m
atggagcaagatcatgtatatcagtataacaacaacgttaatatatattctacagcttcatcatcttcagttcataacactcacgttcctccgtcttcttcggacgatatctctatgtttcttcatcagattctttaccgttcatcatcatcatcgtcaacaacaataacagcgacaacgtcgtctccgaacgtgacccacgtggtcccacacccagtggagatcagtgctcaccgtttgagcaaatcatctgggatctcagccgttgatttagtgaacacgtctgtcggtgttggtggttctttgtcggggaatgtgatggtgagtggagccaacgtgtcctcttcttcagttggacttagcgagaacgaaaacactgatgaacatgattgtcaaagcgaggagggtattcaagcgtcagtagatgaggttacagccaagccagtgcgtcctcgaagttcatcaaaaagaagccgagctgcagaggttcataatttgtctgaaaagaggaggaggagcaggattaatgagaaaatgaaagcattgcaaagcttaataccaaattctaataagaccgacaaagcatcaatgcttgatgaagcgattgagtacctcaagcaccttcagctccaagtacaggtgttaacaatgagaaatggaatgagtttacatcctatgtgcttgcccggcatactgccaccaattcaattacctcatatgagaatgggctttggtgtgggaaatgggtctctgcatatgaactcaacaggcacacttgtaagtcaagaaacatcgacgctgaatgtgtttaatctaccaaatcaacacatttcctcaaaccagctacaactaccctctacatcaaatataataaattcagaaactgagtttgggttggatgcatcaatccaggcaaactttggacccttccagcatggcacagcttct

SEQ ID NO: 641 - protein, 317 aa, Citrus clementina
  clementine0.9_029807m polypeptide
MEQDHVYQYNNNVNIYSTASSSSVHNTHVPPSSSDDISMFLHQILYRSSSSSSTTITATTSSPNVTHVVPHPVEISAHRLSKSSGISAVDLVNTSVGVGGSLSGNVMVSGANVSSSSVGLSENENTDEHDCQSEEGIQASVDEVTAKPVRPRSSSKRSRAAEVHNLSEKRRRSRINEKMKALQSLIPNSNKTDKASMLDEAIEYLKHLQLQVQVLTMRNGMSLHPMCLPGILPPIQLPHMRMGFGVGNGSLHMNSTGTLVSQETSTLNVFNLPNQHISSNQLQLPSTSNIINSETEFGLDASIQANFGPFQHGTASG

SEQ ID NO: 642 - DNA, 939 bp, Oryza sativa
  LOC_Os06g06900.1
atggacgagcagcggggacgcggggggttcgacgaactggtgctcttgcatcagcagcaggagcagcggaggcggagggagcagcagcaggaggaggaggaggaagaggaggtgcggcgccagatgttcggcgcggtggtcggtgggctagccgcgttccctgcggcggcggcggctctgggacagcagcaggtggactgcggcggggagctgggcgggttctgcgacagcgaggcgggcgggtcgtcggagccggaggcggcggcgggggcgcgcccgcgcgggggatccggcagcaagcggagccgcgccgccgaggtgcacaacctctccgagaagaggaggaggagcaagatcaacgagaagatgaaggcattgcagagcctgataccgaattccaacaagactgacaaggcatccatgcttgacgaagccatcgagtacctgaagcaactgcagctccaagtgcagatgctctcaatgagaaacggtgtttacttgaacccatcttatttatctggagcacttgagcctgcgcaagcatcacagatgtttgcagcccttggtggtaacaacgtcacagtggtgcaccccgggacagtgatgccaccagtgaaccaaagctcaggagctcatcatttgtttgatccattgaactctcctccacaaaatcaaccacaatctctaatcctaccaagtgttcctagcacagccattcctgagcctccatttcacctggagtcatcacagtcccaccttcgacaatttcagttgcctggatcctctgagatggtgtttcatggagagataatgccaaagcaccacctatcatcacatcaagaaagtctgccaggaaacgagatgaactccatcaggaaagaatcatccatgttgaacaccaataattttgatggtgtctcacttagcaaagagcaatca

SEQ ID NO: 643 - protein, 313 aa, Oryza sativa
  LOC_Os06g06900.1 polypeptide
MDEQRGRGGFDELVLLHQQQEQRRRREQQQEEEEEEEVRRQMFGAVVGGLAAFPAAAAALGQQQVDCGGELGGFCDSEAGGSSEPEAAAGARPRGGSGSKRSRAAEVHNLSEKRRRSKINEKMKALQSLIPNSNKTDKASMLDEAIEYLKQLQLQVQMLSMRNGVYLNPSYLSGALEPAQASQMFAALGGNNVTVVHPGTVMPPVNQSSGAHHLFDPLNSPPQNQPQSLILPSVPSTAIPEPPFHLESSQSHLRQFQLPGSSEMVFHGEIMPKHHLSSHQESLPGNEMNSIRKESSMLNTNNFDGVSLSKEQS

SEQ ID NO: 644 - DNA, 936 bp, Zea mays
  GRMZM2G017349_T01
atgaacgagcaggggctcggtggtctcggcgggggccgcggggccgtgcaggggcacgggcgggaggcgatggcgctcttgcagcaccagcagcttcaacagcaacggcggcagctggaggaggaggatgaggtgcggcgccagatgttcggcggggtggcggcgttcccggcagcgctgggccacggccagcaggtggactacggggaggacgccggcgggctcggggacagcgacgcgggcgggtcggagcccgagccaccgccggagcggacgcgcggggggtccggcggcggcggcggcaagcggagccgcgctgccgaggtgcacaacctctccgagaagaggaggaggagcaagatcaacgagaagatgaaagcgctgcagagcctgatacccaactccaacaagaccgacaaggcatccatgcttgacgaggccattgagtatctgaagcaactgcagctccaagtgcagatgctgtctatgagaaatggtgtttacttgaaccctccatatttgtctggcacaattgagcctgcacaagcatcacaaatgtttgctgcagttggtgggggcaacattacagcgtcaagctctggggcagtgatgccaccagtaaaccaaagttcaggacttcaagtatttgatccattaaatcctccacgagaccaaccactgtcttttgtattaccaaatgtagacaaaaccattcaagaagctccctttcacttggaatcatcgcagttccaccctcgaccatttcgaatgcctgaatcttctgagatgatgcttccaggtgaggtagtggcaaagcaccagctaacttcaattcaaggaagagttagtatgccaggaattggtatgaaccccattaggcaagaatcatccactgtaaaagctgatcagtttgatggttgctcacatagcaaagag

SEQ ID NO: 645 - protein, 312 aa, Zea mays
  GRMZM2G017349_T01 polypeptide
MNEQGLGGLGGGRGAVQGHGREAMALLQHQQLQQQRRQLEEEDEVRRQMFGGVAAFPAALGHGQQVDYGEDAGGLGDSDAGGSEPEPPPERTRGGSGGGGGKRSRAAEVHNLSEKRRRSKINEKMKALQSLIPNSNKTDKASMLDEAIEYLKQLQLQVQMLSMRNGVYLNPPYLSGTIEPAQASQMFAAVGGGNITASSSGAVMPPVNQSSGLQVFDPLNPPRDQPLSFVLPNVDKTIQEAPFHLESSQFHPRPFRMPESSEMMLPGEVVAKHQLTSIQGRVSMPGIGMNPIRQESSTVKADQFDGCSHSKE

SEQ ID NO: 646 - DNA, 1143 bp, Glycine max
  Glyma11g05810.1
atgggtgacatgtaccactttgacaagaacctctcctcacaagacgaaatctcactttttctgcgtcagattctgctccgttcatcttcaccttcccactccatgcctgctggatcctgcacctccaacgctgctcaacaaaacgtaaatgcacaccacccttctttcacggcgtcacagctccaagatgggaagatcttggccgttgattccaccgcttcttttgtctccggttctgctgcttgcagttccttcaagggccatggtgcttctgctgcaaatgtgtcttcttcttctgctggagtgagtgagaacgagaatgatgactatgattgtgagagtgaggagggtgttgaggctccggccgaagaagttccaacaaaggctgcttcttctaggagttcatctaaaagatcaagagctgcagaagttcataatttgtcagagaagcggagaaggggtaggatcaacgagaaaatgaaggctttgcaaaacctaattccaaattctaacaagacagataaggcttcaatgctcgatgaagctattgaataccttaaacagcttcagctacaagtacagatgctgtcaatgagaaatgggttgagtttgcatcctatgtgctttcctgaaggcttgcagcctctgcagttgtctcagatgggtatggaattaagtgaaagaaacaggtttacctctttaaacatgtcagctactctgcctctgcaccaagacaacaatcccttgcactatgcatccaatctacctaacaaacacaatctcccaaatcagccatctgtgccctatcctccatacattgacaacccagaaacttctttcggtctggaaccccgaatccaaacggatatgaaacctcttcaacacaaaggaggatcttctgagccaatacgaggggaagacattttgcagcaccagcaatcaagtggtatccattcagatgccaatacattaggtggttctcaagttgtcaaagaattcgaatcaggcacgagactatcattcccttttgacacgcaagcatgtgaacccaaagacaacagcaactcttcgcaaccatgcattggcggaagagatcattcaggagtgatcataagaaatagtgagaccaacattgttggtagg

SEQ ID NO: 647 - protein, 381 aa, Glycine max
  Glyma11g05810.1 polypeptide
MGDMYHFDKNLSSQDEISLFLRQILLRSSSPSHSMPAGSCTSNAAQQNVNAHHPSFTASQLQDGKILAVDSTASFVSGSAACSSFKGHGASAANVSSSSAGVSENENDDYDCESEEGVEAPAEEVPTKAASSRSSSKRSRAAEVHNLSEKRRRGRINEKMKALQNLIPNSNKTDKASMLDEAIEYLKQLQLQVQMLSMRNGLSLHPMCFPEGLQPLQLSQMGMELSERNRFTSLNMSATLPLHQDNNPLHYASNLPNKHNLPNQPSVPYPPYIDNPETSFGLEPRIQTDMKPLQHKGGSSEPIRGEDILQHQQSSGIHSDANTLGGSQVVKEFESGTRLSFPFDTQACEPKDNSNSSQPCIGGRDHSGVIIRNSETNIVGR

SEQ ID NO: 648 - DNA, 879 bp, Citrus clementina
  clementine0.9_017382m
atggccgatctgtacggaacaacgccgccaactgccggccacgaaccagaagaaatctcttcatttttaaaccaatttatacacaattcgtcgtcgtcgtcgtcttcttgttttttcgctcagccggaggatcgccaccctttcggccgatcggctgacccctctgttcttgactcttcttctgctggtctcaatttctctaatttggttgtcggtgccgtggactccgataccaatgatagtgagaagggtcctgatgcattggaggtgccatcgaacgacacggttcgaactaaaacgtcgtctaaaaggagcagggctgcagaagttcataatttgtcagaaaagaggcggaggagtagaattaatgagaaactgaaagctctacagaacctaattcccaattctaacaagactgacaaagcttcaatgctggatgaggctattgaatatctgaagcagcttcaacttcaagtacagatgttaacaatgagaaatggattgagtttgcacccaatgtggttaccaggagtactaccatctatgcaactgcctcagacgggaatggtatttgatgagggtaatggactgttgaacaccaatggaggaaccgaaacattttctgcaaatgaagaaagctcggtgcaaactggttttaatctttccagccaatgtaccatctctaatcagccagttgccttaccttcagcagcaaatattagcacatcagaaactgcatttggacttgaaccactgattcaggctcactatggacccttcactctccccccttcttccaaggaaatctgcagtgaaggtgcacctcatctgcatttggatatgaatttcaatggaaaaaactcctcgtctggcgtgtcg

SEQ ID NO: 649 - protein, 293 aa, Citrus clementina
  clementine0.9_017382m polypeptide
MADLYGTTPPTAGHEPEEISSFLNQFIHNSSSSSSSCFFAQPEDRHPFGRSADPSVLDSSSAGLNFSNLVVGAVDSDTNDSEKGPDALEVPSNDTVRTKTSSKRSRAAEVHNLSEKRRRSRINEKLKALQNLIPNSNKTDKASMLDEAIEYLKQLQLQVQMLTMRNGLSLHPMWLPGVLPSMQLPQTGMVFDEGNGLLNTNGGTETFSANEESSVQTGFNLSSQCTISNQPVALPSAANISTSETAFGLEPLIQAHYGPFTLPPSSKEICSEGAPHLHLDMNFNGKNSSSGVS

SEQ ID NO: 650 - DNA, 876 bp, Citrus clementina
  clementine0.9_017468m
atggccgatctgtacggaacaacgccgccaactgccggccacgaaccagaagaaatctcttcatttttaaaccaatttatacacaattcgtcgtcgtcgtcgtcttcttgttttttcgctcagccggaggatcgccaccctttcggccgatcggctgacccctctgttcttgactcttcttctgctggtctcaatttctctaatttggttgtcggtgccgtggactccgataccaatgatagtgagggtcctgatgcattggaggtgccatcgaacgacacggttcgaactaaaacgtcgtctaaaaggagcagggctgcagaagttcataatttgtcagaaaagaggcggaggagtagaattaatgagaaactgaaagctctacagaacctaattcccaattctaacaagactgacaaagcttcaatgctggatgaggctattgaatatctgaagcagcttcaacttcaagtacagatgttaacaatgagaaatggattgagtttgcacccaatgtggttaccaggagtactaccatctatgcaactgcctcagacgggaatggtatttgatgagggtaatggactgttgaacaccaatggaggaaccgaaacattttctgcaaatgaagaaagctcggtgcaaactggttttaatctttccagccaatgtaccatctctaatcagccagttgccttaccttcagcagcaaatattagcacatcagaaactgcatttggacttgaaccactgattcaggctcactatggacccttcactctccccccttcttccaaggaaatctgcagtgaaggtgcacctcatctgcatttggatatgaatttcaatggaaaaaactcctcgtctggcgtgtcg

SEQ ID NO: 651 - protein, 292 aa, Citrus clementina
  clementine0.9_017468m polypeptide
MADLYGTTPPTAGHEPEEISSFLNQFIHNSSSSSSSCFFAQPEDRHPFGRSADPSVLDSSSAGLNFSNLVVGAVDSDTNDSEGPDALEVPSNDTVRTKTSSKRSRAAEVHNLSEKRRRSRINEKLKALQNLIPNSNKTDKASMLDEAIEYLKQLQLQVQMLTMRNGLSLHPMWLPGVLPSMQLPQTGMVFDEGNGLLNTNGGTETFSANEESSVQTGFNLSSQCTISNQPVALPSAANISTSETAFGLEPLIQAHYGPFTLPPSSKEICSEGAPHLHLDMNFNGKNSSSGVS

SEQ ID NO: 652 - DNA, 842 bp, Oryza sativa
  LOC_Os02g56140.1
atgatggatgggcgaggaagccaggaggaggagcacctggatttgatcatgcgacaccacgccagcatggggctggatcgctgcgagagcgaggaggcgctggggtcgtcggagtcggagcagcccaccaggccggcgcggccgcgcggcaagaggagccgcgccgccgaggtgcacaacctctccgagaagaggaggaggagcagaatcaatgagaagatgaaggccctgcagagcctcattcccaactccagcaagacggacaaagcctccatgcttgacgatgccatcgagtacctgaagcagcttcagctccaggtccagatgttgtccatgaggaatggtctatatctgcccccagtgaacttatctggggcacctgagcatctgccgatcccgcaaatgagtgctgcacttgaccagaatagtgccaaagcatcagatccttcagttgttttgcagccggtgaaccagacttcaggagcacttcttccatttgagctggcaagccaacataaacctctattcttaccaggtgttcctaatgcaaccgctctggagcctcggttccttgtagagtcttcgcgttccaatcttcaatccttacggttcactgaacccgctgagatgatctatcctgatgagatgatgttaaagcaccgcctgacttcagctagtgagagcacaattgtgccaggaaccgatgagaagtcggttaggcagaacacatacatgatgaatgctgatcgttttgatagatatgcactcagcaaagaccagttgcagcacattatgccgaaaaacacagaaagtgtacttgatatgccacacttgcaaaggta

SEQ ID NO: 653 - protein, 280 aa, Oryza sativa
  LOC_Os02g56140.1 polypeptide
MMDGRGSQEEEHLDLIMRHHASMGLDRCESEEALGSSESEQPTRPARPRGKRSRAAEVHNLSEKRRRSRINEKMKALQSLIPNSSKTDKASMLDDAIEYLKQLQLQVQMLSMRNGLYLPPVNLSGAPEHLPIPQMSAALDQNSAKASDPSVVLQPVNQTSGALLPFELASQHKPLFLPGVPNATALEPRFLVESSRSNLQSLRFTEPAEMIYPDEMMLKHRLTSASESTIVPGTDEKSVRQNTYMMNADRFDRYALSKDQLQHIMPKNTESVLDMPHLQR

SEQ ID NO: 654 - DNA, 942 bp, Solanum lycopersicum
  Solyc04g078690.2.1
atggcggatccgtacagaacgaaccctcacgcttcttcatctctcgaatccgaagatatgtcttccttttttcttaattttcttcaaggaacgcccgcttcctcttctgcgactgctgcggctggtttttataaccgatcgggaccggcgccggtggctgagtcatcttctagcctcaatttctccgatcccggccgattttatgctgccgagttcaaggaaggcgttgagaatgtgtttgcttctgctggcctcggggaatgtgacggtatgaattcagctaataggagagagtttttggaagatgataaggttgataacttcggttttagtagcgaggaatgtgatggacttgacatgccatctgatccgactcatccacgttcttcaaagaggagtagatctgctgaagttcataatttgtccgagaagaggaggaggagtaggatcaatgagaaactgaaagcattgcagaacctaattccgaattctaacaaaactgacaaggcatctatgcttgatgaagccattgaatatctgaagcaacttcaactgcaagttcagattcttaccttgaggaatgggttgagtttatacccaggatatgttcccgggtctttgcagtcggtgcaacttccatctggtaatgaatttgatgggagaagttttatgctgagtgcaaatggaggagctacacttcctgtgaatcgagaaatgccacaaactgcatttgaaatttccaatcagaatccgtcaggcaaaccaacaataacctcacataacacagaaaacgctgtagctttagaaactacaattcagaatcattatggacttcttaaccatttagcatcttctaaggacatgtgccgagacaatacactatcaagattgcatttagatatgagttgctctggaaacaattcatcatcaggagtgtcgtct

SEQ ID NO: 655 - protein, 314 aa, Solanum lycopersicum
  Solyc04g078690.2.1 polypeptide
MADPYRTNPHASSSLESEDMSSFFLNFLQGTPASSSATAAAGFYNRSGPAPVAESSSSLNFSDPGRFYAAEFKEGVENVFASAGLGECDGMNSANRREFLEDDKVDNFGFSSEECDGLDMPSDPTHPRSSKRSRSAEVHNLSEKRRRSRINEKLKALQNLIPNSNKTDKASMLDEAIEYLKQLQLQVQILTLRNGLSLYPGYVPGSLQSVQLPSGNEFDGRSFMLSANGGATLPVNREMPQTAFEISNQNPSGKPTITSHNTENAVALETTIQNHYGLLNHLASSKDMCRDNTLSRLHLDMSCSGNNSSSGVSS

SEQ ID NO: 656 - DNA, 434 bp, Glycine max
  Glyma17g19500.1
gaagaagaggttccaactccaccaaagtcgattcgttctaggagttcctccaaaaggaacagagctgcggaagttcataacctctctgaaaagcggaggaggagtaggatcaatgagaaattgaaggctttgcaaaatcttattccaaattctaacaagactgataaggcttcaatgcttgatgaagctattgaatatcttaaacagcttcatctcaaagtacagatgctgtcaatgagaaatgggttgagtttgcatactatgttctttcaagaaggtttgcaacctctgcaattgtctcaggtgccgagaatggattcaggtgaagaaagcagacttatcccttcaaacccaacagcttctctgcctatgcaccaagaaaaccccatgcactatttgtccaatctacctaacaaactcgccatggcagatca

SEQ ID NO: 657 - protein, 145 aa, Glycine max
  Glyma17g19500.1 polypeptide
EEEVPTPPKSIRSRSSSKRNRAAEVHNLSEKRRRSRINEKLKALQNLIPNSNKTDKASMLDEAIEYLKQLHLKVQMLSMRNGLSLHTMFFQEGLQPLQLSQVPRMDSGEESRLIPSNPTASLPMHQENPMHYLSNLPNKLAMADQ

SEQ ID NO: 658 - DNA, 660 bp, Populus trichocarpa
  POPTR_0005s18280.1
atgggagatgtctacaataacgaaaccaacaacattaataacacctgctcagcttcctcttcttctcgtcattaccaccgttcatcagacgatatctcacttttcctccatcaaattcttccccgttcaccttcatcaacgtcttcttcctcatttataggcccacagacgctgcagccattttcagtgccagccccctttgatgatcctcttcgatcgggagtgatcttaggtgtggattcgagtggtggaggtggtggtgctctttggtctgggaatgtgagaacgagactgatcatgagtgagaacgagactgatcatgagtgtgattgtgaaagcgaggagggtttggaagctttaatagatgagatgtcagtaaagccagctcctccacgaagctcaaagagaacaagagctgcagaagttcataatttgtctgagaagaggaggaggagcaggattaatgagaaaatgaaggcactgcaaaatttgattccaaattccagcaagacagataaggcttcaatgctggatgaagctattgagtatctcaagctgctccagctccaagtacagggattaagtgttaggtttcttgaaatatatagatccagtgaaaacgataaatttaaaatttttttagagttcaaaggattctat

SEQ ID NO: 659 - protein, 220 aa, Populus trichocarpa
  POPTR_0005s18280.1 polypeptide
MGDVYNNETNNINNTCSASSSSRHYHRSSDDISLFLHQILPRSPSSTSSSSFIGPQTLQPFSVPAPFDDPLRSGVILGVDSSGGGGGALWSGNVRTRLIMSENETDHECDCESEEGLEALIDEMSVKPAPPRSSKRTRAAEVHNLSEKRRRSRINEKMKALQNLIPNSSKTDKASMLDEAIEYLKLLQLQVQGLSVRFLEIYRSSENDKFKIFLEFKGFY

SEQ ID NO: 660 - DNA, 837 bp, Zea mays
  GRMZM2G030744_T02
atggacgcgcagcagcagctggatttggtcatgcgtcaccagagcatggccaccgtctgcgagagcgaggacgcgctggggtcgtcggagtcggatcccgcgaggccggcgcgcccgcgcggcaagaggagccgcgccgccgaggtgcacaacctctccgagaagaggaggaggagcaggatcaacgagaagatgaaggcgctgcagaccctcatacccaactcgagcaagacggacaaggcttccatgcttgatgatgccattgagtacctgaagcatcttcagctccaggtgcagatgttgtctatgaggaatggcctctatctgcccccaggaaacctgtctggagcacccgagactctggcacccttagaaatgtgcgcagcacttaaccaaagtggtgccaaggcatcaaattccggcgttgtcgttctacctggaaacaaaattcctgtagctcgtcttctacttgatccaccaaaccatgatcagcggcatgaaaacccgcttgtattacaaagtgttcctagtagttcgaccgctgtagagcctcggttccttcaacagccagcacagcccaacctccaatcctttcagctggctgtacctcccgagatgatcttcgacgaggcggacatgatgctaaagcatcgcctagcttcaggtcgagaaaccacatctctaccaggacatgaggccaagcctggtaggcaggaagcatgcatggtaaattctgatatttctaacagaggttcactcgggaaagaagtatttatgccctacttgcatagcttgcagagcggcgatacggagggaggtctgagggcaggatcaaac

SEQ ID NO: 661 - protein, 279 aa, Zea mays
  GRMZM2G030744_T02 polypeptide
MDAQQQLDLVMRHQSMATVCESEDALGSSESDPARPARPRGKRSRAAEVHNLSEKRRRSRINEKMKALQTLIPNSSKTDKASMLDDAIEYLKHLQLQVQMLSMRNGLYLPPGNLSGAPETLAPLEMCAALNQSGAKASNSGVVVLPGNKIPVARLLLDPPNHDQRHENPLVLQSVPSSSTAVEPRFLQQPAQPNLQSFQLAVPPEMIFDEADMMLKHRLASGRETTSLPGHEAKPGRQEACMVNSDISNRGSLGKEVFMPYLHSLQSGDTEGGLRAGSN

SEQ ID NO: 662 - DNA, 840 bp, Zea mays
  GRMZM2G030744_T03
atggacgcgcagcagcagctggatttggtcatgcgtcaccagagcatggccaccgtctgcgagagcgaggacgcgctggggtcgtcggagtcggatcccgcgaggccggcgcgcccgcgcggcaagaggagccgcgccgccgaggtgcacaacctctccgagaagaggaggaggagcaggatcaacgagaagatgaaggcgctgcagaccctcatacccaactcgagcaagacggacaaggcttccatgcttgatgatgccattgagtacctgaagcatcttcagctccaggtgcagatgttgtctatgaggaatggcctctatctgcccccaggaaacctgtctggagcacccgagactctggcacccttagaaatgtgcgcagcacttaaccaaagtggtgccaaggcatcaaattccggcgttgtcgttctacctggaaacaaaattcctgtagctcgtcttctacttgatccaccaaaccatgatcagcggcatgaaaacccgcttgtattacaaagtgttcctagtagttcgaccgctgtagagcctcggttccttcaacagccagcacagcccaacctccaatcctttcagctggctgtacctcccgagatgatcttcgacgaggcggacatgatgctaaagcatcgcctagcttcaggtcgagaaaccacatctctaccagtaggacatgaggccaagcctggtaggcaggaagcatgcatggtaaattctgatatttctaacagaggttcactcgggaaagaagtatttatgccctacttgcatagcttgcagagcggcgatacggagggaggtctgagggcaggatcaaac

SEQ ID NO: 663 - protein, 280 aa, Zea mays
  GRMZM2G030744_T03 polypeptide
MDAQQQLDLVMRHQSMATVCESEDALGSSESDPARPARPRGKRSRAAEVHNLSEKRRRSRINEKMKALQTLIPNSSKTDKASMLDDAIEYLKHLQLQVQMLSMRNGLYLPPGNLSGAPETLAPLEMCAALNQSGAKASNSGVVVLPGNKIPVARLLLDPPNHDQRHENPLVLQSVPSSSTAVEPRFLQQPAQPNLQSFQLAVPPEMIFDEADMMLKHRLASGRETTSLPVGHEAKPGRQEACMVNSDISNRGSLGKEVFMPYLHSLQSGDTEGGLRAGSN

SEQ ID NO: 664 - DNA, 630 bp, Arabidopsis thaliana
  AT5G67110.1
atgggtgattctgacgtcggtgatcgtcttccccctccatcttcttccgacgaactctcgagctttctccgacagattctttcccgtactcctacagctcaaccttcttcaccaccgaagagtactaatgtttcctccgctgagaccttcttcccttccgtttccggcggagctgtttcttccgtcggttatggagtctctgaaactggccaagacaaatatgctttcgaacacaagagaagtggagctaaacagagaaattcgttgaagagaaacattgatgctcaattccacaacttgtctgaaaagaagaggaggagcaagatcaacgagaaaatgaaagctttgcagaaactcattcccaattccaacaagactgataaagcctcaatgcttgatgaagctatagaatatctgaagcagcttcaacttcaagtccagactttagccgttatgaatggtttaggcttaaaccctatgcgattaccacaggttccacctccaactcatacaaggatcaatgagaccttagagcaagacctgaacctagagactcttctcgctgctcctcactcgctggaaccagctaaaacaagtcaaggaatgtgcttttccacagccactctgctt

SEQ ID NO: 665 - protein, 210 aa, Arabidopsis thaliana
  AT5G67110.1 polypeptide
MGDSDVGDRLPPPSSSDELSSFLRQILSRTPTAQPSSPPKSTNVSSAETFFPSVSGGAVSSVGYGVSETGQDKYAFEHKRSGAKQRNSLKRNIDAQFHNLSEKKRRSKINEKMKALQKLIPNSNKTDKASMLDEAIEYLKQLQLQVQTLAVMNGLGLNPMRLPQVPPPTHTRINETLEQDLNLETLLAAPHSLEPAKTSQGMCFSTATLL

SEQ ID NO: 666 - protein, 57 aa, Arabidopsis thaliana
  AT4G36930 HLH domain
RCRAAEVHNLSEKRRRSRINEKMKALQSLIPNSNKTDKASMLDEAIEYLKQLQLQVQ

SEQ ID NO: 667 - protein, 57 aa, Brachypodium distachyon
  Bradi1g48400.1 HLH domain
RTRAAEVHNLSEKRRRSRINEKMKALQSLIPNSNKTDKASMLDEAIEYLKQLQLQVQ

SEQ ID NO: 668 - protein, 57 aa, Glycine max
  Glyma01g39450.1 HLH domain
RSRAAEVHNLSEKRRRSRINEKMKALQNLIPNSNKTDKASMLDEAIEYLKQLQLQVQ

SEQ ID NO: 669 - protein, 57 aa, Populus trichocarpa; identical to SEQ ID NO: 668
  POPTR_0014s02590.1 HLH domain

SEQ ID NO: 670 - protein, 57 aa, Solanum lycopersicum
  Solyc02g093280.2.1 HLH domain
RSRAAEVHNLSEKRRRSRINEKMKALQKLIPNSNKTDKASMLDEAIEYLKQLQLQVQ

SEQ ID NO: 671 - protein, 57 aa, Eucalyptus grandis
  Eucgr.I00906.1 HLH domain
RSRTAEVHNLSEKRRRSRINEKMKALQSLIPNSNKTDKASMLDEAIEYLKQLQLQVQ

SEQ ID NO: 672 - protein, 57 aa, Vitis vinifera; identical to SEQ ID NO: 668
  GSVIVT01022111001 HLH domain

SEQ ID NO: 673 - protein, 57 aa, Vitis vinifera; identical to SEQ ID NO: 668
  GSVIVT01009467001 HLH domain

SEQ ID NO: 674 - protein, 57 aa, Citrus clementine
  clementine0.9_029807m HLH domain
RSRAAEVHNLSEKRRRSRINEKMKALQSLIPNSNKTDKASMLDEAIEYLKHLQLQVQ

SEQ ID NO: 675 - protein, 57 aa, Orysa sativa
  LOC_Os06g06900.1 HLH domain
RSRAAEVHNLSEKRRRSKINEKMKALQSLIPNSNKTDKASMLDEAIEYLKQLQLQVQ

SEQ ID NO: 676 - protein, 57 aa, Zea mays; identical to SEQ ID NO: 675
  GRMZM2G017349_T01 HLH domain

SEQ ID NO: 677 - protein, 57 aa, Glycine max
  Glyma11g05810.1 HLH domain
RSRAAEVHNLSEKRRRGRINEKMKALQNLIPNSNKTDKASMLDEAIEYLKQLQLQVQ

SEQ ID NO: 678 - protein, 57 aa, Citrus clementine
  clementine0.9_017382m HLH domain
RSRAAEVHNLSEKRRRSRINEKLKALQNLIPNSNKTDKASMLDEAIEYLKQLQLQVQ

SEQ ID NO: 679 - protein, 57 aa, Citrus clementine; identical to SEQ ID NO: 678
  clementine0.9_017468m HLH domain

SEQ ID NO: 680 - protein, 57 aa, Orysa sativa
  LOC_Os02g56140.1 HLH domain
RSRAAEVHNLSEKRRRSRINEKMKALQSLIPNSSKTDKASMLDDAIEYLKQLQLQVQ

SEQ ID NO: 681 - protein, 57 aa, Solanum lycopersicum
  Solyc04g078690.2.1 HLH domain
RSRSAEVHNLSEKRRRSRINEKLKALQNLIPNSNKTDKASMLDEAIEYLKQLQLQVQ

SEQ ID NO: 682 - protein, 57 aa, Glycine max
  Glyma17g19500.1 HLH domain
RNRAAEVHNLSEKRRRSRINEKLKALQNLIPNSNKTDKASMLDEAIEYLKQLHLKVQ

SEQ ID NO: 683 - protein, 57 aa, Populus trichocarpa
  POPTR_0005s18280.1 HLH domain
RTRAAEVHNLSEKRRRSRINEKMKALQNLIPNSSKTDKASMLDEAIEYLKLLQLQVQ

SEQ ID NO: 684 - protein, 57 aa, Zea mays
  GRMZM2G030744_T02 HLH domain
RSRAAEVHNLSEKRRRSRINEKMKALQTLIPNSSKTDKASMLDDAIEYLKHLQLQVQ

SEQ ID NO: 685 - protein, 57 aa, Zea mays; identical to SEQ ID NO: 684
  GRMZM2G030744_T03 HLH domain

SEQ ID NO: 686 - protein, 57 aa, Arabidopsis thaliana
  AT5G67110.1 HLH domain
RNIDAQFHNLSEKKRRSKINEKMKALQKLIPNSNKTDKASMLDEAIEYLKQLQLQVQ

SEQ ID NO: 687 - protein, 62 aa, Arabidopsis thaliana
  SPATULA clade consensus sequence
  misc_feature (3)..(5): Xaa can be any naturally occurring amino acid
  misc_feature (7)..(7): Xaa can be Glu or Gln
  misc_feature (8)..(8): Xaa can be any naturally occurring amino acid
  misc_feature (15)..(15): Xaa can be Arg or Lys
  misc_feature (18)..(18): Xaa can be Gly or Ser
  misc_feature (19)..(19): Xaa can be Arg or Lys
  misc_feature (24)..(24): Xaa can be Ile, Val, Leu, or Met
  misc_feature (29)..(29): Xaa can be any naturally occurring amino acid
  misc_feature (35)..(35): Xaa can be any naturally occurring amino acid
  misc_feature (42)..(42): Xaa can be Ile, Val, Leu, or Met
  misc_feature (45)..(45): Xaa can be Glu or Asp
  misc_feature (52)..(52): Xaa can be any naturally occurring amino acid
  misc_feature (54)..(54): Xaa can be Gln or His
  misc_feature (56)..(56): Xaa can be Gln or Lys
  misc_feature (59)..(59): Xaa can be any naturally occurring amino acid
  misc_feature (60)..(60): Xaa can be Ile, Val, Leu, or Met or absent
  misc_feature (61)..(61): Xaa can be Ser, Thr, Ala, or absent
  misc_feature (62)..(62): Xaa can be Ile, Val, Leu, or Met or absent
KRXXXAXXHNLSEKXRRXXINEKXKALQXLIPNSXKTDKASXLDXAIEYLKXLXLXVQXXXX

SEQ ID NO: 688 - DNA, 1434 bp, Arabidopsis thaliana
  AT2G20180.2
atgcatcattttgtccctgacttcgataccgatgatgattatgtcaacaaccataattcttctttgaatcatcttcctagaaaatccattactactatgggtgaagatgatgatcttatggagcttttatggcagaacggtcaagttgttgttcaaaaccagagacttcacaccaagaaaccttcttcttctccaccgaagcttcttccttctatggatcctcagcagcaaccttcttcagatcagaatctttttattcaagaagatgaaatgacttcttggcttcattatcctctccgtgacgatgatttctgctcagatcttctcttctccgccgcacctactgcgacggctaccgcgacggtgagtcaagtcaccgccgcgagaccgccagtatcttcgacgaatgagtcgaggccgccggtgaggaacttcatgaatttctcgaggctgagaggggattttaataacggtagaggtggtgaatctggaccgttgctttcgaaggcggttgtgagagaatctacgcaggtaagtcctagcgcaacaccgtcggcggcggcgagtgaatccggtttaacacggcggacggatggtactgacagttccgccgtagctggaggcggcgcgtataatcggaagggaaaagcagtggctatgacggcgccggcgatcgagataaccggtacatcgtcatctgtagtgtcaaagagcgaaatcgaaccggagaagacgaacgtcgatgataggaaacgaaaagagagagaagccaccactactgatgaaactgaatcccgtagcgaggaaacaaaacaagcacgtgtatcaacaacatctaccaagagatctcgtgctgctgaagttcataatctctctgaaagaaaacggagagataggatcaatgagagaatgaaagctttgcaagaacttatacctcgctgcaacaagtcagataaagcttcgatgctagatgaagctattgagtacatgaaatctcttcagcttcaaatacagatgatgtcaatgggatgtggaatgatgccaatgatgtatccgggcatgcaacagtacatgcctcatatggcgatgggtatgggtatgaaccagcctattcctcctccttccttcatgccattccccaacatgttagccgctcaaagacctttgcctacacaaactcacatggccgggtcaggaccgcaataccctgttcatgcttctgacccgtcaagagtctttgtaccgaaccagcagtatgatccaacctcgggccagcctcagtatccagctggttacacggatccatatcagcagttccgcggtctccacccgacccaaccacctcagtttcagaatcaagcaacatcgtacccaagttcgagcagggtgagtagtagtaaggaatctgaggatcacggaaaccacacaacaggt

SEQ ID NO: 689 - protein, 478 aa, Arabidopsis thaliana
  AT2G20180.2 polypeptide
MHHFVPDFDTDDDYVNNHNSSLNHLPRKSITTMGEDDDLMELLWQNGQVVVQNQRLHTKKPSSSPPKLLPSMDPQQQPSSDQNLFIQEDEMTSWLHYPLRDDDFCSDLLFSAAPTATATATVSQVTAARPPVSSTNESRPPVRNFMNFSRLRGDFNNGRGGESGPLLSKAVVRESTQVSPSATPSAAASESGLTRRTDGTDSSAVAGGGAYNRKGKAVAMTAPAIEITGTSSSVVSKSEIEPEKTNVDDRKRKEREATTTDETESRSEETKQARVSTTSTKRSRAAEVHNLSERKRRDRINERMKALQELIPRCNKSDKASMLDEAIEYMKSLQLQIQMMSMGCGMMPMMYPGMQQYMPHMAMGMGMNQPIPPPSFMPFPNMLAAQRPLPTQTHMAGSGPQYPVHASDPSRVFVPNQQYDPTSGQPQYPAGYTDPYQQFRGLHPTQPPQFQNQATSYPSSSRVSSSKESEDHGNHTTG

SEQ ID NO: 690 - DNA, 1443 bp, Glycine max
  Glyma03g32740.1
atggagctgctatggcacaacggccaggtcgtggtgcagagtcagaaccaacgttctctgagaaaacttccgccggtgaccaactcccacgacgcctctcccgccggtccttcaatgacgagagagattcgaccgctggtggagaatttcaatcagcatctcttcatgcacgaaggcgaaatggcttcgtggcttcactatcctatcgacgacgacgagcctgccttcatgcaaaccctcggccacacgtctcagctcacggagctccggccgatgtcggcgaatccacggcctccgattccgcccccgagaaggccggaacagaggacgccgaacttcgcgtacttctcgaggcacaacacgagagccgcggagccgagcgtgaaggccgccgcgagggaatccacggtggtggattcgtgcgatacggaggcggcggcttcgagagtttcggagacagtaaggagcgcggcggaaggaggtgccggcgttgcggcgccttcgacgagtgccggcggtggaaggagcacgatgatgtacgatttgacgatgacgtcatcgcctggcggttcgagtagctgcgacgagccggttcaggtagcggcggcggaggaggatcggaagcggaagggacgggaggcggaggaatgggagtgtcagagcgagttacaaattccctgtaccctggtatacgctaacgtgcgctgggtgagtgacgtgggtttacgtgagcactccccgcgctgctgcatttatttcggtgctgtggccttgtgctcttttggtacggtcatcactttcaccgtcgtggctgcgcacgtgcaagcaaagaagcaagtttgtggatcaacatctacaaagagatcccgtgctgccgaggtccataatctctctgagaggaggcgtcgcgatcggattaatgaaaagatgaaagctctgcaagaacttatacctcgttgcaataagtcggacaaagcttcaatgctggatgaagcaatttcgtacttgaagtcattgcagttacaagtgcagatgatgtccatgggatgtggaatggtacctgtgatgtttcctggaatccagcagtacatgccagcaatgggaatgggggttggaatgggtatgggtatggaaatgggaatgaacagacctgtaatgccgtttcccaatatgttacctggttcggctttgccagcggcaactgcagctgctgctcatttgggaccaagaatgcaagcagcaaatcagtcagataataatatggtcacgtcagctggtccacctgatccaaatcagtcacgtatcccaaacttcactgatccttatcaacaatatcttggtccccaccagatgcagttccaattaattcagaatcaggcaatgaaccaaccaaatgttagcaagccaagtaacaatgggggccctgcgaatccagaaaaccat

SEQ ID NO: 691 - protein, 481 aa, Glycine max
  Glyma03g32740.1 polypeptide
MELLWHNGQVVVQSQNQRSLRKLPPVTNSHDASPAGPSMTREIRPLVENFNQHLFMHEGEMASWLHYPIDDDEPAFMQTLGHTSQLTELRPMSANPRPPIPPPRRPEQRTPNFAYFSRHNTRAAEPSVKAAARESTVVDSCDTEAAASRVSETVRSAAEGGAGVAAPSTSAGGGRSTMMYDLTMTSSPGGSSSCDEPVQVAAAEEDRKRKGREAEEWECQSELQIPCTLVYANVRWVSDVGLREHSPRCCIYFGAVALCSFGTVITFTVVAAHVQAKKQVCGSTSTKRSRAAEVHNLSERRRRDRINEKMKALQELIPRCNKSDKASMLDEAISYLKSLQLQVQMMSMGCGMVPVMFPGIQQYMPAMGMGVGMGMGMEMGMNRPVMPFPNMLPGSALPAATAAAAHLGPRMQAANQSDNNMVTSAGPPDPNQSRIPNFTDPYQQYLGPHQMQFQLIQNQAMNQPNVSKPSNNGGPANPENH

SEQ ID NO: 692 - DNA, 1299 bp, Glycine max
  Glyma10g04890.1
atggacgacgacgacgaagaatacccaattcccgtctcaaagaaaccctccacgcaaaacgatgagatcatggaactgttatggcaaaacggccaggtcgtgatgcaaaaccaaaaccaacgaccgttcagaaaacaaccgccgacgacggacggcgacggccccattccggcgagggagattcgatcctccgaagcggaaaactacaatagccaacacttgttcatgcaagaagacgaaatggcgtcgtggctgcactatccaatccatgaagatcctcctcccttcgatcaccacgatttctgcgccgacatcctctacccgccgccaaacgccaccgcgagccagaatcaaagcagcgcctccgtgcagtcctccccgacggtagccacggcggagcacgtggaaaccggccgcgcgagcgtcagcgccgccgccggtaaaacccccgcgtcggatggcgggagggagacggcgacgtgcgacgtgaccgtgacgtcatcgcctggcggttcgagcgggagcgctgaaccggttcagagagaaccagtggtgaaccggaagaggaagggaagggaacaagaggaatcggagtatcagagcgaggtaactaaaaagcaagttcgtggttctacatctacgaaaagatctcatgctgcagaagtccataatctctcagagaggaggcgtcgagatagaattaatgagaagatgaaagctttgcaagaacttatacctcggtgcaacaagtctgacaaagcttcaatgctggatgaagcaattgagtacttgaagtcactgcaattacaagtgcagatgatgtccatgggatgtggcatggtacctatgatatttcctggaatccagcagtatatgccaccaatgggaatggggattgggatgggtatgggtatgggcatggaaatgggaatgggaatgaacagatcagtaatgccatttcccaatatgttagctagttcgactttgccagcagcaactgcaactgctcatttgggaccaaggtttcctatgcctcctttccatatgccccatgttgctacacctgattcatccagaatgcaaggagcaaatcacccagataataatatgcttaactcacttggtacactagatccagatcaatcatgtatcccaaacttcactgatccttatcaacagtacctcagtctccaacaggcacagttacaattaatgcagacaatgaaccaaccaaatgtcagcaagcctagtactagtagaggtcaagagaatccagaaaagcatcagtcagacaaaaca

SEQ ID NO: 693 - protein, 433 aa, Glycine max
  Glyma10g04890.1 polypeptide
MDDDDEEYPIPVSKKPSTQNDEIMELLWQNGQVVMQNQNQRPFRKQPPTTDGDGPIPAREIRSSEAENYNSQHLFMQEDEMASWLHYPIHEDPPPFDHHDFCADILYPPPNATASQNQSSASVQSSPTVATAEHVETGRASVSAAAGKTPASDGGRETATCDVTVTSSPGGSSGSAEPVQREPVVNRKRKGREQEESEYQSEVTKKQVRGSTSTKRSHAAEVHNLSERRRRDRINEKMKALQELIPRCNKSDKASMLDEAIEYLKSLQLQVQMMSMGCGMVPMIFPGIQQYMPPMGMGIGMGMGMGMEMGMGMNRSVMPFPNMLASSTLPAATATAHLGPRFPMPPFHMPHVATPDSSRMQGANHPDNNMLNSLGTLDPDQSCIPNFTDPYQQYLSLQQAQLQLMQTMNQPNVSKPSTSRGQENPEKHQSDKT

SEQ ID NO: 694 - DNA, 1434 bp, Glycine max
  Glyma13g19250.1
atggaactgttatggcaaaacggccaggtcgtgatgcaaagccagaaccaacgacccttcagaaagccgccgcagccgccggaggccaacggcggcgacggcgccatttcggcgagggagattcgatcatctgaagcagaaaactacaataatagccaacacttgttcatgcaagaagacgaaatggcggcgtggctgcactatccaatccacgaagatcctccacccttcgatcaccacgatttcggcgccgacatcttctacccgccgccaaacgccaccgcgagccagaatcgcggcagcgccgccgtgcagtcctcctttcgcacgacagagctctggcatccggctcctcgacctccgattccgccgccgaggcggccggagcatgcgccgagcaggatacacaatttcgcgcacttcacgaagcacggcaatgcgtcgtcgagctcgaaggcggccgcggcggcgcagccgacggtggtggattcttgcgaaacgccggtcgcgacggcggagcacgcggaaaccggccgcgccagagccgccgccggcaaaaccgcggtgtcggacggcgggagagagacggcgacgtgcgacgtgacggtgacgtcatcgcctggcgattcgagcgggagtgccgaaccggtcgagagagaaccgatggcggaccggaagaggaagggaagggaacatgaggaatcggagtttcagagcgaggatgttgattttgaatctcccgaagctaaaaagcaagttcatggttctacatctacaaagagatctcgtgctgcagaagtccataatctctctgagaggcgccgtcgagatagaattaatgaaaagatgaaagctttgcaagaacttatacctaggtgcaacaagtctgacaaagcttcaatgctggatgaagcaattgagtacttgaagtcactgcaattacaagtgcagatgatgtccatgggatatggcatggtacctatgatgtttcctggaatacagcagtatatgccaccaatgggaatggggattgggatggggatgggcatggaaatgggaatgggaatgaacagaccagtaatgccatttaccaatatgttagctagttcgactttgccagcagcaactgcggctgttcatttgggaccaaggtttcctatgcctcctttccatatgccccatgttgctgcacccgattcatccagaatgcaaggagcaaatcacccagataataatatgcttaactcacttggtacactagatccagatcaatcacgtatcccaaacttcactgatccttatcaacagtacctcggtctccaacaggcacagttacaattaatgcagacaatgaaccaacaaaatgtcagcaagcctagtagcagtagaggtcaagagaatccagaaaagcatcagtcaggtaaagtgccattg

SEQ ID NO: 695 - protein, 478 aa, Glycine max
  Glyma13g19250.1 polypeptide
MELLWQNGQVVMQSQNQRPFRKPPQPPEANGGDGAISAREIRSSEAENYNNSQHLFMQEDEMAAWLHYPIHEDPPPFDHHDFGADIFYPPPNATASQNRGSAAVQSSFRTTELWHPAPRPPIPPPRRPEHAPSRIHNFAHFTKHGNASSSSKAAAAAQPTVVDSCETPVATAEHAETGRARAAAGKTAVSDGGRETATCDVTVTSSPGDSSGSAEPVEREPMADRKRKGREHEESEFQSEDVDFESPEAKKQVHGSTSTKRSRAAEVHNLSERRRRDRINEKMKALQELIPRCNKSDKASMLDEAIEYLKSLQLQVQMMSMGYGMVPMMFPGIQQYMPPMGMGIGMGMGMEMGMGMNRPVMPFTNMLASSTLPAATAAVHLGPRFPMPPFHMPHVAAPDSSRMQGANHPDNNMLNSLGTLDPDQSRIPNFTDPYQQYLGLQQAQLQLMQTMNQQNVSKPSSSRGQENPEKHQSGKVPL

SEQ ID NO: 696 - DNA, 1845 bp, Populus trichocarpa
  POPTR_0002s25410.1
atgaatccttatgttcctgattttgaaatggacgatgattactctctcccacctcctccttcaacccatactcgccccagaaaaccagccatgcaggaagaagagatcatggagctactatggcagaacggccaagtagtgatgcatagtcaaagatctcaaaagaaatcatctcctccaccgtccgagttggatgatgcggtgctcccagctgatcaattacctggtactaaagagatccgatcatcacatgatcaacaacaagaacatcaccatctttttatgcaagaagatgagatggcttcttggcttaatcatcctctaaacgacaccaatttcgaccatgatttctgcgccgatttgctatatcctccgacagcttccaccgcttccatcaccagggaagctgctgtcaccaacgccgctgcgtctactgttcgaggtgcgactcagagaatggaagctaggagttatccggcggtatcggcgccgaggccgccgataccgccggtgaggagagcggaggtggtgcagaacttcgcgtacttctcgaggcaccgagcgggaggagtttcggaatctggacggtctaattcgaagagcgtggtgagggaatcgacggttgttgactcgtgtgagactccaacagcgagaatttcggagacggcgtttgctagaagtgcggataacacgtgtgggaccattaacggcgctgctgtagcaggcacggtttctagtgctccctcaagtaatagagagacgatgacgaatccttgtgagatgacctccacgtcatcacctggttgctcgagtgctagcgctgagctgccggctctgatgtctccagtggaagaccggaagcggaagggaagagaagaggaagctgagtgtcatagcgagtttattgcaataagcattacaatggcacatggtaatcaacctcagtcagtagcaatcaggcagaaaacccaaaacagtgcagacagctcgaaacctcttcagggtagaagagatgccgcaaatccactaaaggatgctgagtttgaatctgctgatgcaaagaaacgaattcgtggatcaatgtcttcgaagagatctcgtgcagcagaagttcacaacctatcagaaaggagacgccgagatcggatcaatgaaaagatgagggctttgcaagagctcatacctcgttgcaacaagtcggacaaagcttctatgttagatgaggcaattgagtacctgaaatcgcttcagttgcaagtacagatgatgtctatgggatgcagcatggtccccatgatgtttcctggcttccagcagtacatgccgccaatggggatagggatgggcatgggcatggaaatgggattgagtcggccaatgatgccatttcccaatattttggcgggtgcaccctcagcaacaccagctgcagcagctcatttggtccctaggttccctgtgccgccctttcatgtgccccccatccctgctcctgatccatccagagtccaaccaaccaaccaggtagatcctatgctaggctcaccaggtcaacagaatccaaaccaaccacgagtcccaaattttgttgatccatatcagcactatcttggcctctaccagatgcatttaccaggagtaccacggaaccaagctatggctcagccaagtaccagcaagccaagtactagtcgagtagctgagaatcctggcaatcaccagtcaggttgtgatggggaaaaaatggctcatgcttttccttcaagtcaggctaaaaaacaggagtggaaaatggggaaaggaataaatggagttatgctacgtgggtgtccacctctatctcaa

SEQ ID NO: 697 - protein, 615 aa, Populus trichocarpa
  POPTR_0002s25410.1 polypeptide
MNPYVPDFEMDDDYSLPPPPSTHTRPRKPAMQEEEIMELLWQNGQVVMHSQRSQKKSSPPPSELDDAVLPADQLPGTKEIRSSHDQQQEHHHLFMQEDEMASWLNHPLNDTNFDHDFCADLLYPPTASTASITREAAVTNAAASTVRGATQRMEARSYPAVSAPRPPIPPVRRAEVVQNFAYFSRHRAGGVSESGRSNSKSVVRESTVVDSCETPTARISETAFARSADNTCGTINGAAVAGTVSSAPSSNRETMTNPCEMTSTSSPGCSSASAELPALMSPVEDRKRKGREEEAECHSEFIAISITMAHGNQPQSVAIRQKTQNSADSSKPLQGRRDAANPLKDAEFESADAKKRIRGSMSSKRSRAAEVHNLSERRRRDRINEKMRALQELIPRCNKSDKASMLDEAIEYLKSLQLQVQMMSMGCSMVPMMFPGFQQYMPPMGIGMGMGMEMGLSRPMMPFPNILAGAPSATPAAAAHLVPRFPVPPFHVPPIPAPDPSRVQPTNQVDPMLGSPGQQNPNQPRVPNFVDPYQHYLGLYQMHLPGVPRNQAMAQPSTSKPSTSRVAENPGNHQSGCDGEKMAHAFPSSQAKKQEWKMGKGINGVMLRGCPPLSQ

SEQ ID NO: 698 - DNA, 1536 bp, Solanum lycopersicum
  Solyc06g008030.2.1
atgaattactgtgttgttcctgatttcaaaatggatgatgattattatgatattccttctgctattttcaacaagaaatccacaatagcagatgaagaaatcatggagctagtatggcaaaatggtggagtaattatgcaaagccaaaatcaaagatctgtaaggaaatctaacctttttcccgagcaatcagctgtagaacaaacggtagcagtttcagctccactgtatatgcaagaggatgaaatgaactcatggcttcaatctccacttgatgattcctccttcgatgattttctaaatactacaccgagttgtgacgccgtgacctccgccgctgcagcaccgccgggagaaattggtacttcgaaggtggagatccgtccgcctctggttccgccgtgttcgcggccgattagatgtacagagggtgaattaccacatcgattacagaattttgggcatttttcacggttgtctggtgaagcggttttacgaaatggtactacatcgagttctggtcactcagttagggcatcgacgattgtggattcaaacgagactccggtagcagcacgcgtatcagaaaatgtaacaccagttaccgccatgaatgtcagaggaagagaactgacggcgacgtcgatggcgacaacaagcggcggtagggaagtgacgatggcatgcgagttggcattgacagcatctacacgtggttcaggaggtagtgtaagcgccagagcaggaccgccacagccgtcgcatacggaggcggatacggcggcgtatgatcggaaacggaaaagtagagaatcggacgacaatgaaggtcagagtgaggatgttgaatatgagtttgctgatgcaaggaagcaagtaagaagttctacatcggcaaagaaatctcgcgcagcagaggtccataatctttctgaaaggaaacgccgagacagaataaatgagaagatgaaggctctacaagaactcataccttgctgcaataagtcagacaaagcttcaatgctggatgaagcaattgagtaccttaaatcattgcaattgcaagtacagatgatggccacgggatgcagcatggttcctatgatgtatcctggaatcccgcaatacatgccaactatgggaatgaatatgagcatggggatggatatgaaaatgggcaggaaccggccattaatttcatatccaccgctaatgccaggtccagcaatgcagaatgcagctgcagcagcacaaatggctcctcaatatcctcttccggcatatcacttgccaccatttcctgcacctgatccatccagaatcccagttgcgaaccagccaaactcacatgttggacataatattagtcagccaagacttcccaattttagtgacccatactatcaatattttggtctacagcaagcacaactgatgttaccccagaatcaggaagtggaacagctgagcagcagtaaacttaacagctgcatagaaggaagtagagggaatcatcaatctggtgagcatactatt

SEQ ID NO: 699 - protein, 512 aa, Solanum lycopersicum
  Solyc06g008030.2.1 polypeptide
MNYCVVPDFKMDDDYYDIPSAIFNKKSTIADEEIMELVWQNGGVIMQSQNQRSVRKSNLFPEQSAVEQTVAVSAPLYMQEDEMNSWLQSPLDDSSFDDFLNTTPSCDAVTSAAAAPPGEIGTSKVEIRPPLVPPCSRPIRCTEGELPHRLQNFGHFSRLSGEAVLRNGTTSSSGHSVRASTIVDSNETPVAARVSENVTPVTAMNVRGRELTATSMATTSGGREVTMACELALTASTRGSGGSVSARAGPPQPSHTEADTAAYDRKRKSRESDDNEGQSEDVEYEFADARKQVRSSTSAKKSRAAEVHNLSERKRRDRINEKMKALQELIPCCNKSDKASMLDEAIEYLKSLQLQVQMMATGCSMVPMMYPGIPQYMPTMGMNMSMGMDMKMGRNRPLISYPPLMPGPAMQNAAAAAQMAPQYPLPAYHLPPFPAPDPSRIPVANQPNSHVGHNISQPRLPNFSDPYYQYFGLQQAQLMLPQNQEVEQLSSSKLNSCIEGSRGNHQSGEHTI

SEQ ID NO: 700 - DNA, 1671 bp, Solanum lycopersicum
  Solyc09g063010.2.1
atgaatcattctgttcctgattttgatatggatgatgacttctctcttcctgcttcttctggtattaccagaactaagaagtccgcaatggcggaagaggaaatcatggaactactgtggcaaaatggtcaagtggttatgcagagtcaaaatcaaagatctcttaagaaacctcacatcggtaacggcagtggaggtggtggtgatgcggttattccctctgaccaagctgtcagtagagagatccgtcatgtagaggaaactactccacatcatctgtttatgcaggaggacgagatggcctcgtggcttcattacccactcgatgacccctccttcgaacgtgatctctactccgatctcctatatcccacgcccacttctaccttcaccaccgccgcgctgccacgagaaaaccgtacgtctacgtttgagatccgtccacctccgccacaaccatcgcctgcagcgccgatcggaacggctcctcgaccgcctatacctccttctaggcgcaccgtcacagaaaattcaaatcgattccagaacttcggacacttctcgcgattgcctaaagcaaggctagaacctggtcaggctaacttaagcaagtcaccaagagattcaacggtcgtggattcaaacgtaactccaattacagggcaggaatctagagttacactcatacctgataatgtggtagcagtacccggcggaaatgtaggatgtagtacagtaaacggcagcaccggaactgcgacagcgtcaacggcaattagggaaccgacgactacatgtgatatttcaatgacgtcatctccgggtggctcaggaaatagtgtaagcgccagtgccgaaccaccagcaccagcaccagcaccgtcgcataagggggcggcaccaacggcaacggcagcagcggatgatcggaaacggaaagggagagaaatggaggacgaaggtcagaatgaggatgctgaatttgagtctcctgatacgaaaaagcaagcacgcggttcaacatccacaaagagatctcgtgctgcggaggtccataatctttcagaaaggagacgtagagacagaataaatgagaagatgaaggccctgcaggaactcataccacgctgtaacaagacggacaaagcttcaatgcttgatgaggcaattgagtatttgaaatcactacaattgcaagtgcagatgatgtccatgggatgtggcatggtcccgatgatgtatcctggaatgcagccgtacatgccgccaatgggaatgggcatgggtatggggatggggatggatattggcatgaacaggccaatggtgccatatccacctctattaccaggtacagcgatgcagaatgcagctgcagcagcacaaatgggtcctagattttctatccctcaatttcatttgccaccagttccagtaccagatccatccagaatgcaagcctcaagtcagccagatccaatgctaaattcacttgtttcacataattcgaaccagccaagacttccgaattttagtgatccatatcagcagttttttggtctccagcaagcgcaagttgcattaccgcagaatcaggcagtagaacagcccagtaatagtaaatccggcagcagcaaagaagttggaaatccaggcaatcatcaatctggt

SEQ ID NO: 701 - protein, 557 aa, Solanum lycopersicum
  Solyc09g063010.2.1 polypeptide
MNHSVPDFDMDDDFSLPASSGITRTKKSAMAEEEIMELLWQNGQVVMQSQNQRSLKKPHIGNGSGGGGDAVIPSDQAVSREIRHVEETTPHHLFMQEDEMASWLHYPLDDPSFERDLYSDLLYPTPTSTFTTAALPRENRTSTFEIRPPPPQPSPAAPIGTAPRPPIPPSRRTVTENSNRFQNFGHFSRLPKARLEPGQANLSKSPRDSTVVDSNVTPITGQESRVTLIPDNVVAVPGGNVGCSTVNGSTGTATASTAIREPTTTCDISMTSSPGGSGNSVSASAEPPAPAPAPSHKGAAPTATAAADDRKRKGREMEDEGQNEDAEFESPDTKKQARGSTSTKRSRAAEVHNLSERRRRDRINEKMKALQELIPRCNKTDKASMLDEAIEYLKSLQLQVQMMSMGCGMVPMMYPGMQPYMPPMGMGMGMGMGMDIGMNRPMVPYPPLLPGTAMQNAAAAAQMGPRFSIPQFHLPPVPVPDPSRMQASSQPDPMLNSLVSHNSNQPRLPNFSDPYQQFFGLQQAQVALPQNQAVEQPSNSKSGSSKEVGNPGNHQSG

SEQ ID NO: 702 - DNA, 1599 bp, Eucalyptus grandis
  Eucgr.K03592.1
atgctggtttcttttttttcctcattctcttccggggccgcggctgcggtcagggccggcgatgagatcgcggagctgctgtggcagaacggccccgtggttatgcagagccagcgatcggtcaagaaatcggagccctccggctgcgacggttaccagctgagcgcgatccagagccagactcagcatcagcatcagcatcagcatcagcatcagcagcagcagcagcagcagcagcagcagcagcagcaggagcgggagcaggagcagcagcagcagcacctcttcatgcaggaagacgagatggcctcctggctccactatcctctcaacgacgcctccttcgtcgccgatttctgctccgatcttctctaccctcctccttgcgccaacgtcaacgtcgccgcgaccgccgctcgcgcttctcccgttgtcgcggagctccggcagcaaccgccgcccaagccgccgacgccgatggctcctccgaggagattcgagaacttcggccacttctcgaggctgaatcggcctagagtcgacgaatccgggccgtccaattcgtcccgcgcggggaacgaatcgaccgtggttgattccagcgggacgcccgcggtggggccccgctctagggtttccgaggcattgcattgcgacgtctcgcgcgggaccgtcgacggtggagcggcggccttggccacgtcgtcggccgatggcggcggtcgcgagatggggacgtgcgagttgacggtgacttcatcgccgggcgcctccagcgcctgcgctgagcctctgccgcctcggaagtcgtcgtcgacgccaccgccgccggcggaggacaggaagcggaaggggatcgagatcgaccccgacgccgaccccgacgctgacgagtgccacagcgaggatgttgagcttgaatctgccgatacaaagaaaccagcacgtggctccacatcttctaagaggtctcgagctgcagaggtccacaatctgtcagagaggagacggcgggataggataaatgaaaaaatgaaggctctacaagaattaattccgcattgtaacaagtctgataaggcttcgatgctggacgaggcaattgagtacttgaagtcgcttcaaatgcaagtgcagatgatgtccatgggatgtggtgtcgtaccaatgatgtttccaggtgttcatcagtacgtgccccacatggggatgggtattggcatggccatgggtatggatatgggaatgaatcgccctattttgccttttccaaacattttatctggttcagcactgccgacgccagcagctggagctcatctgggtccaagatttcctatgccaacctttcatatgcctcatgttcgtgcacctgatccatccagaatttccccaaccatccagtctaatcctttgttaagctctctcgctttacaaagtcaaaatcaggcgagggtcccaaactttattgatccttaccaacagtactttggcctccgccatatgcagttgccactgcagcagaatcagactccctctggtagcagcaagccaagcaccagcaaagtaggggagaatcttgaaaaaccaccatcaggc

SEQ ID NO: 703 - protein, 533 aa, Eucalyptus grandis
  Eucgr.K03592.1 polypeptide
MLVSFFSSFSSGAAAAVRAGDEIAELLWQNGPVVMQSQRSVKKSEPSGCDGYQLSAIQSQTQHQHQHQHQHQQQQQQQQQQQQQEREQEQQQQHLFMQEDEMASWLHYPLNDASFVADFCSDLLYPPPCANVNVAATAARASPVVAELRQQPPPKPPTPMAPPRRFENFGHFSRLNRPRVDESGPSNSSRAGNESTVVDSSGTPAVGPRSRVSEALHCDVSRGTVDGGAAALATSSADGGGREMGTCELTVTSSPGASSACAEPLPPRKSSSTPPPPAEDRKRKGIEIDPDADPDADECHSEDVELESADTKKPARGSTSSKRSRAAEVHNLSERRRRDRINEKMKALQELIPHCNKSDKASMLDEAIEYLKSLQMQVQMMSMGCGVVPMMFPGVHQYVPHMGMGIGMAMGMDMGMNRPILPFPNILSGSALPTPAAGAHLGPRFPMPTFHMPHVRAPDPSRISPTIQSNPLLSSLALQSQNQARVPNFIDPYQQYFGLRHMQLPLQQNQTPSGSSKPSTSKVGENLEKPPSG

SEQ ID NO: 704 - DNA, 1437 bp, Vitis vinifera
  GSVIVT01028516001
atgaatcactgcgtacctgattttgaggtagatgatgaggacgcgattcccttgaccagaccgaagaaatcagcggccatggttgaggatgatgaaatcatggagctgctctggcagaatggtcaggtggtgatgcagatccagaatcagcgatctttcaagaaatcccagccttcgaaatttccaattcaagatgctgtgcttccgccggagcagtccaagatccggtcatcggctccggtggatgagtccagcgctcagctcttcatgcaggaagatgagatggcttcgtggcttcactacccgctcgacgatttctgtgctgatctcctcgatcctacgccgtgtgttaatgcctctccccctccggcgcggcctaatttgtcgccggatgtccgtcagcctgaggagaggcctgctgcgacgaagccgccgattccgccggcgaggagggtggagctggactccaaggttcacaacttcctgcatttcccgaggaaatcgactgccgaatctggagagcctagctcaagcaggccggcggggatggaatcgacggtggccgcgacgtcagcagccggggaacatacaacatttgagctcacgatgacgtcatctcctgaagggtccgggtctggcggcagcgccagcgccggagccgaaccgactccgaaagcgccggcggacgatcgaaaacggaagggaagagaaggcgacgacacggccgagtaccagagcgaggacgttgagtttgaatctgctgatgcaaagaaacaagtccgtggatcagcgactgcaaagagatcccgtgctgcggaggttcacaacctgtctgagaggagacgtcgagacaggataaatgaaaagatgaaggctttgcaagaactaatacctcgttgcaacaagtctgacaaagcttcgatgctggatgaagcaattgagtacttgaaatcacttcagttgcaagttcagatgatgtcgatgggatgcagcatggtccctatgatgtatcctggcgtccagcagtacatgccacaaatggggatgggaatgggcatgggcatgggcatggagatgggtatgaaccgtccaatgatgccatttccctctgttttaggtggctcaaccttgcccacaacagctgcagcagctcatttgggtcaaagatatcctatgccagcctttcatatgccccacatggctgcacctgattcatctaggatccaagcaaacaaccagtcggatccggttctgaactcacttggcacacaaagttccaaccagccacgggttcccaatttcgcagatccatatctgcagtacctccagcagatgcaaatgccaccagctcagaatcaagcaatgggccagcaaaatacgagcaagccaagtaccagcaaaggaactgagaatctcgaaaatcaccgatcaggtagg

SEQ ID NO: 705 - protein, 479 aa, Vitis vinifera
  GSVIVT01028516001 polypeptide
MNHCVPDFEVDDEDAIPLTRPKKSAAMVEDDEIMELLWQNGQVVMQIQNQRSFKKSQPSKFPIQDAVLPPEQSKIRSSAPVDESSAQLFMQEDEMASWLHYPLDDFCADLLDPTPCVNASPPPARPNLSPDVRQPEERPAATKPPIPPARRVELDSKVHNFLHFPRKSTAESGEPSSSRPAGMESTVAATSAAGEHTTFELTMTSSPEGSGSGGSASAGAEPTPKAPADDRKRKGREGDDTAEYQSEDVEFESADAKKQVRGSATAKRSRAAEVHNLSERRRRDRINEKMKALQELIPRCNKSDKASMLDEAIEYLKSLQLQVQMMSMGCSMVPMMYPGVQQYMPQMGMGMGMGMGMEMGMNRPMMPFPSVLGGSTLPTTAAAAHLGQRYPMPAFHMPHMAAPDSSRIQANNQSDPVLNSLGTQSSNQPRVPNFADPYLQYLQQMQMPPAQNQAMGQQNTSKPSTSKGTENLENHRSGR

SEQ ID NO: 706 - DNA, 1815 bp, Citrus clementina
  clementine0.9_005396m
atgtcagggtcggggacaattacaattttacatataaagcgtgaaaatagttttcgtcttttagcttcatattattccgaacatttcctcatcatcacaaaattcatatcacccttttcttcctctctacacataagaaagaagaaaggaaggagaatcaaatcatcatcattaaggatgaatcactgtgttccagattttgagttcgacgacgatcactcgatccctacttcttcagttttaaatcgccctagaaaatcagccatggcggaggaggatgttatggagctgctatggcaaaacggcccagtcgttttgcataaccagaatcagagatccctcaagaaatcgcagccttcgtttcccgccgaccaatcagctcctagagagatcccttcctcacaccatcaccagcaagaacaacaggatcacctgtttatgcaagaagatgaaatggcttcttggcttcactatccccttaatgacactaatttcgactctgatttttgcaccgatcttctttatccagctccttgtattacttccactaccactacgaccgccacagccacagccacgcctccggttcgtgccactcgcgtgagagactcacgacctcagctgaatactgctactactgttgcttcggctccgcctttgaggcctccgattcctcctccaccgagaaggacggagaatttcggtctcttcgccaggcacatgccgagggaggtagcatcaggaccgtccaattcgaagagcgtgacgatcagagaatcgactgtagtggactccagcgatactcccgccccggggcccgattctagggcttcggaggccatgaggagtatggaaggcgcgtctggcgtcaacaataataataggtgccggaacacgagcggcgctggagctgcggctacgtcatctggcggaggcggcggcagtagtggagcgagagatttgaccatgtgcgaaatgacggtgacgtcatcacctgggggctcaagcgccagcgcggagccgccggctcagaagccagctgctgaggaccgtaaacgtaaagggagggaaaccgacgacgaatatcacagcgaggatgttgaattggaatctgctgatgcaaagaagcaatctcgtggttcaacatctgcaaagagatctcgtgctgcggaggtccacaatctctcggagaggagacgccgagataggataaatgaaaagatgcgggctttgcaagaactcatacctcgttgcaacaagtcggacaaagcttcgatgctggatgaggcaattgagtacctgaaagcacttcaattgcaagtccagatgatgtcagtgggatgtggcgtggttcccatgatgttccctggtgtccagcaatacatgccaaacatggggatgggaattggaatgggcatgggcatgggcatgggcatggatatgggaatgagtcggcctatgatgccatttccaaatgttttggctggttcagccatgccaacaccagctgctgctgctcatttaggtccaaggtttccaatgccgccctttcacatgccacctgttcccggtcctgatccatccagagtccaagctgccaaccattcagatcccatgttcaattcgtttggcatgcaaaatccaaaccaagcacgggcttcaaattttgttgatccttatcagcagtatcttgcccttcaccggatgcagttacctcttcaacagaatcaatcaatggtccagccaaatgcaagcaaaccaagcaccagtaagggagctgaaaatcgtgagaatcctgagaatcacccatctggt

SEQ ID NO: 707 - protein, 605 aa, Citrus clementina
  clementine0.9_005396m polypeptide
MSGSGTITILHIKRENSFRLLASYYSEHFLIITKFISPFSSSLHIRKKKGRRIKSSSLRMNHCVPDFEFDDDHSIPTSSVLNRPRKSAMAEEDVMELLWQNGPVVLHNQNQRSLKKSQPSFPADQSAPREIPSSHHHQQEQQDHLFMQEDEMASWLHYPLNDTNFDSDFCTDLLYPAPCITSTTTTTATATATPPVRATRVRDSRPQLNTATTVASAPPLRPPIPPPPRRTENFGLFARHMPREVASGPSNSKSVTIRESTVVDSSDTPAPGPDSRASEAMRSMEGASGVNNNNRCRNTSGAGAAATSSGGGGGSSGARDLTMCEMTVTSSPGGSSASAEPPAQKPAAEDRKRKGRETDDEYHSEDVELESADAKKQSRGSTSAKRSRAAEVHNLSERRRRDRINEKMRALQELIPRCNKSDKASMLDEAIEYLKALQLQVQMMSVGCGVVPMMFPGVQQYMPNMGMGIGMGMGMGMGMDMGMSRPMMPFPNVLAGSAMPTPAAAAHLGPRFPMPPFHMPPVPGPDPSRVQAANHSDPMFNSFGMQNPNQARASNFVDPYQQYLALHRMQLPLQQNQSMVQPNASKPSTSKGAENRENPENHPSG

SEQ ID NO: 708 - DNA, 1785 bp, Citrus clementina
  clementine0.9_005585m
atgtcagggtcggggacaattacaattttacatataaagcgtgaaaatagttttcgtcttttagcttcatattattccgaacatttcctcatcatcacaaaattcatatcacccttttcttcctctctacacataagaaagaagaaaggaaggagaatcaaatcatcatcattaaggatgaatcactgtgttccagattttgagttcgacgacgatcactcgatccctacttcttcagttttaaatcgccctagaaaatcagccatggcggaggaggatgttatggagctgctatggcaaaacggcccagtcgttttgcataaccagaatcagagatccctcaagaaatcgcagccttcgtttcccgccgaccaatcagctcctagagagatcccttcctcacaccatcaccagcaagaacaacaggatcacctgtttatgcaagaagatgaaatggcttcttggcttcactatccccttaatgacactaatttcgactctgatttttgcaccgatcttctttatccagctccttgtattacttccactaccactacgaccgccacagccacagccacgcctccggttcgtgccactcgcgtgagagactcacgacctcagctgaatactgctactactgttgcttcggctccgcctttgaggcctccgattcctcctccaccgagaaggacggagaatttcggtctcttcgccaggcacatgccgagggaggtagcatcaggaccgtccaattcgaagagcgtgacgatcagagaatcgactgtagtggactccagcgatactcccgccccggggagtatggaaggcgcgtctggcgtcaacaataataataggtgccggaacacgagcggcgctggagctgcggctacgtcatctggcggaggcggcggcagtagtggagcgagagatttgaccatgtgcgaaatgacggtgacgtcatcacctgggggctcaagcgccagcgcggagccgccggctcagaagccagctgctgaggaccgtaaacgtaaagggagggaaaccgacgacgaatatcacagcgaggatgttgaattggaatctgctgatgcaaagaagcaatctcgtggttcaacatctgcaaagagatctcgtgctgcggaggtccacaatctctcggagaggagacgccgagataggataaatgaaaagatgcgggctttgcaagaactcatacctcgttgcaacaagtcggacaaagcttcgatgctggatgaggcaattgagtacctgaaagcacttcaattgcaagtccagatgatgtcagtgggatgtggcgtggttcccatgatgttccctggtgtccagcaatacatgccaaacatggggatgggaattggaatgggcatgggcatgggcatgggcatggatatgggaatgagtcggcctatgatgccatttccaaatgttttggctggttcagccatgccaacaccagctgctgctgctcatttaggtccaaggtttccaatgccgccctttcacatgccacctgttcccggtcctgatccatccagagtccaagctgccaaccattcagatcccatgttcaattcgtttggcatgcaaaatccaaaccaagcacgggcttcaaattttgttgatccttatcagcagtatcttgcccttcaccggatgcagttacctcttcaacagaatcaatcaatggtccagccaaatgcaagcaaaccaagcaccagtaagggagctgaaaatcgtgagaatcctgagaatcacccatctggt

SEQ ID NO: 709 - protein, 595 aa, Citrus clementina
  clementine0.9_005585m polypeptide
MSGSGTITILHIKRENSFRLLASYYSEHFLIITKFISPFSSSLHIRKKKGRRIKSSSLRMNHCVPDFEFDDDHSIPTSSVLNRPRKSAMAEEDVMELLWQNGPVVLHNQNQRSLKKSQPSFPADQSAPREIPSSHHHQQEQQDHLFMQEDEMASWLHYPLNDTNFDSDFCTDLLYPAPCITSTTTTTATATATPPVRATRVRDSRPQLNTATTVASAPPLRPPIPPPPRRTENFGLFARHMPREVASGPSNSKSVTIRESTVVDSSDTPAPGSMEGASGVNNNNRCRNTSGAGAAATSSGGGGGSSGARDLTMCEMTVTSSPGGSSASAEPPAQKPAAEDRKRKGRETDDEYHSEDVELESADAKKQSRGSTSAKRSRAAEVHNLSERRRRDRINEKMRALQELIPRCNKSDKASMLDEAIEYLKALQLQVQMMSVGCGVVPMMFPGVQQYMPNMGMGIGMGMGMGMGMDMGMSRPMMPFPNVLAGSAMPTPAAAAHLGPRFPMPPFHMPPVPGPDPSRVQAANHSDPMFNSFGMQNPNQARASNFVDPYQQYLALHRMQLPLQQNQSMVQPNASKPSTSKGAENRENPENHPSG

SEQ ID NO: 710 - DNA, 1638 bp, Citrus clementina
  clementine0.9_006684m
atgaatcactgtgttccagattttgagttcgacgacgatcactcgatccctacttcttcagttttaaatcgccctagaaaatcagccatggcggaggaggatgttatggagctgctatggcaaaacggcccagtcgttttgcataaccagaatcagagatccctcaagaaatcgcagccttcgtttcccgccgaccaatcagctcctagagagatcccttcctcacaccatcaccagcaagaacaacaggatcacctgtttatgcaagaagatgaaatggcttcttggcttcactatccccttaatgacactaatttcgactctgatttttgcaccgatcttctttatccagctccttgtattacttccactaccactacgaccgccacagccacagccacgcctccggttcgtgccactcgcgtgagagactcacgacctcagctgaatactgctactactgttgcttcggctccgcctttgaggcctccgattcctcctccaccgagaaggacggagaatttcggtctcttcgccaggcacatgccgagggaggtagcatcaggaccgtccaattcgaagagcgtgacgatcagagaatcgactgtagtggactccagcgatactcccgccccggggcccgattctagggcttcggaggccatgaggagtatggaaggcgcgtctggcgtcaacaataataataggtgccggaacacgagcggcgctggagctgcggctacgtcatctggcggaggcggcggcagtagtggagcgagagatttgaccatgtgcgaaatgacggtgacgtcatcacctgggggctcaagcgccagcgcggagccgccggctcagaagccagctgctgaggaccgtaaacgtaaagggagggaaaccgacgacgaatatcacagcgaggatgttgaattggaatctgctgatgcaaagaagcaatctcgtggttcaacatctgcaaagagatctcgtgctgcggaggtccacaatctctcggagaggagacgccgagataggataaatgaaaagatgcgggctttgcaagaactcatacctcgttgcaacaagtcggacaaagcttcgatgctggatgaggcaattgagtacctgaaagcacttcaattgcaagtccagatgatgtcagtgggatgtggcgtggttcccatgatgttccctggtgtccagcaatacatgccaaacatggggatgggaattggaatgggcatgggcatgggcatgggcatggatatgggaatgagtcggcctatgatgccatttccaaatgttttggctggttcagccatgccaacaccagctgctgctgctcatttaggtccaaggtttccaatgccgccctttcacatgccacctgttcccggtcctgatccatccagagtccaagctgccaaccattcagatcccatgttcaattcgtttggcatgcaaaatccaaaccaagcacgggcttcaaattttgttgatccttatcagcagtatcttgcccttcaccggatgcagttacctcttcaacagaatcaatcaatggtccagccaaatgcaagcaaaccaagcaccagtaagggagctgaaaatcgtgagaatcctgagaatcacccatctggt

SEQ ID NO: 711 - protein, 546 aa, Citrus clementina
  clementine0.9_006684m polypeptide
MNHCVPDFEFDDDHSIPTSSVLNRPRKSAMAEEDVMELLWQNGPVVLHNQNQRSLKKSQPSFPADQSAPREIPSSHHHQQEQQDHLFMQEDEMASWLHYPLNDTNFDSDFCTDLLYPAPCITSTTTTTATATATPPVRATRVRDSRPQLNTATTVASAPPLRPPIPPPPRRTENFGLFARHMPREVASGPSNSKSVTIRESTVVDSSDTPAPGPDSRASEAMRSMEGASGVNNNNRCRNTSGAGAAATSSGGGGGSSGARDLTMCEMTVTSSPGGSSASAEPPAQKPAAEDRKRKGRETDDEYHSEDVELESADAKKQSRGSTSAKRSRAAEVHNLSERRRRDRINEKMRALQELIPRCNKSDKASMLDEAIEYLKALQLQVQMMSVGCGVVPMMFPGVQQYMPNMGMGIGMGMGMGMGMDMGMSRPMMPFPNVLAGSAMPTPAAAAHLGPRFPMPPFHMPPVPGPDPSRVQAANHSDPMFNSFGMQNPNQARASNFVDPYQQYLALHRMQLPLQQNQSMVQPNASKPSTSKGAENRENPENHPSG

SEQ ID NO: 712 - DNA, 1335 bp, Brachypodium distachyon
  Bradi1g13980.1
atgggagacgcatccagacccctcggcgtggacgatgacctcatggagctgctgtggtgcaacggccatgtggtcatgcagagccagactcaccggaagctgccgccgaggcccgaaaaggcggcggcggcggcggcggtgatgcaagaagacgaggccgggctgtggttccctttctcgcacgccgactcgctcgacaaggacatcttctcggacctcttctgcgaagccgtgcctcaggcagtggggatcaagccggactgctacggagacggcaacggcagcaagtcgtccgacgcgccgagcgagctgatgccgccgcccaagtcgaccatggcggacggcggcgagctgtcggacctcgtgcaggcccggtccacggggaaggcggcggcggcggccatggagcaggagggcgcgtcggcgtcgtcgttctgcgggagcagcaaccaggtgcaggtgcagcacgccggccgcgtgcagtccgcgggcaccgctgcctacggcagcagcgcccggctgcagtcggcggtgggcagcgggattaatgcaaacggcagaggccgtgaggccacggtggcgtcgtcgtcggggcgctccaacggctgcttcacgaacacgacgacgacgtccacggagccgacgagcgcgagcctccggagcagcagcaagcggaagcggctcgacagccgcaccgaggactactccgagagccccagcgaggacgcggagtcggagtccttggcgctcatcgagcgcaagcctccgctgaagctccccacggccaggaggagccgcgcagccgaggtgcacaacctctccgagcggaggagacgagacaggatcaacgagaagatgaaggccttgcaagaactcatacctcactgcaacaagacggacaaggcgtcgatgctggacgaggccatcgagtacctgaagacgctgcagatgcaggtgcagatgatgtggatgggcagcggcatggcgccgccggcggtgatgttcccgggcatgcaccagtacctgccgcggcggatgccttccttcatggccccgccgcccgcggcggcggcggcggcgcagagcctgccggaccactacgcgcacttcctcggcgtcaaccaccacctgcagccgccgtcccaccaccatcagcattatgcggcgcaggggatgggatactacccgttgggggccaaggccgtgcagcaaagtccagcgcttccgattcaccacgtgcacagtactgccaatggcgccacgcctgcccctgctgccgccgccgccgctaccaacagtaacacgccgggaaacgggatgcatccaaacagaata

SEQ ID NO: 713 - protein, 445 aa, Brachypodium distachyon
  Bradi1g13980.1 polypeptide
MGDASRPLGVDDDLMELLWCNGHVVMQSQTHRKLPPRPEKAAAAAAVMQEDEAGLWFPFSHADSLDKDIFSDLFCEAVPQAVGIKPDCYGDGNGSKSSDAPSELMPPPKSTMADGGELSDLVQARSTGKAAAAAMEQEGASASSFCGSSNQVQVQHAGRVQSAGTAAYGSSARLQSAVGSGINANGRGREATVASSSGRSNGCFTNTTTTSTEPTSASLRSSSKRKRLDSRTEDYSESPSEDAESESLALIERKPPLKLPTARRSRAAEVHNLSERRRRDRINEKMKALQELIPHCNKTDKASMLDEAIEYLKTLQMQVQMMWMGSGMAPPAVMFPGMHQYLPRRMPSFMAPPPAAAAAAQSLPDHYAHFLGVNHHLQPPSHHHQHYAAQGMGYYPLGAKAVQQSPALPIHHVHSTANGATPAPAAAAAATNSNTPGNGMHPNRI

SEQ ID NO: 714 - DNA, 1263 bp, Oryza sativa
  LOC_Os03g56950.1
atggatggcaatgcgagatcggcggcgaatcagacgaagcaaatcgtcacggacaacgagctggtggagctgctatggcacaacggcggcgtcgtggcgcagccgcaggcggcgcaggcgagggtcgtctcctcctccggccgcggccagagcgccagcgtgctcaccggcgacgacacggagaccgccgcgtggttcccggacaccctcgacgacgcgctggagaaggacctctacacgcagctctggcgcagcgtcaccggcgacgcgttcccggcggccgcggcggcggggccgagctctcaccacgctccgccgccggacttgccgcccccggcggcgaggccgccgatgaggagcggcatcgggtcgagctggaccggcgacatctgttcggccttctgcggcagcaaccacatcccggagacggcggcgcagcgctgccgggacgccggcgcggcattgccgccggagcggccgcgccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgaggatgctgaatgcgaggcaaccgaagagaccaaatcgtcgtcgcggcgatatggatcaaagaggagaactcgtgcagctgaagttcataacctgtcagagaggagaagaagggatcggatcaacgagaagatgcgcgcattgcaagaactcatacctcattgcaacaagaccgacaaggcatctatattagatgaagcaatcgagtatctgaagtcactccaaatgcaagttcagatcatgtggatgactactgggatggcaccaatgatgttccctggtgctcaccagttcatgccaccaatggccgtgggcatgaattctgcgtgcatgcctgcggcacaaggcctaagtcacatgtcaagattgccatacatgaaccattctatgccaaatcacatccctctaaattcatctccagctatgaacccaatgaatgttgcaaaccagatgcagaacattcaactgagagaggcaagcaatcccttccttcacccagatggctggcaaacagtgccaccacaggtatcaggaccatatgcttctgggcctcaagtagcacagcaaaaccagataccgaaagcgtcagctagcactgttctgccaaattctggggctgaacaaccaccaacctctgatggaatt

SEQ ID NO: 715 - protein, 421 aa, Oryza sativa
  LOC_Os03g56950.1 polypeptide
MDGNARSAANQTKQIVTDNELVELLWHNGGVVAQPQAAQARVVSSSGRGQSASVLTGDDTETAAWFPDTLDDALEKDLYTQLWRSVTGDAFPAAAAAGPSSHHAPPPDLPPPAARPPMRSGIGSSWTGDICSAFCGSNHIPETAAQRCRDAGAALPPERPRRSSTHDGAGTSSSGGSGSNFGASGLPSESASAHKRKGREDSDSRSEDAECEATEETKSSSRRYGSKRRTRAAEVHNLSERRRRDRINEKMRALQELIPHCNKTDKASILDEAIEYLKSLQMQVQIMWMTTGMAPMMFPGAHQFMPPMAVGMNSACMPAAQGLSHMSRLPYMNHSMPNHIPLNSSPAMNPMNVANQMQNIQLREASNPFLHPDGWQTVPPQVSGPYASGPQVAQQNQIPKASASTVLPNSGAEQPPTSDGI

SEQ ID NO: 716 - DNA, 1230 bp, Oryza sativa
  LOC_Os03g56950.3
atggcgatttgcagcacggacaacgagctggtggagctgctatggcacaacggcggcgtcgtggcgcagccgcaggcggcgcaggcgagggtcgtctcctcctccggccgcggccagagcgccagcgtgctcaccggcgacgacacggagaccgccgcgtggttcccggacaccctcgacgacgcgctggagaaggacctctacacgcagctctggcgcagcgtcaccggcgacgcgttcccggcggccgcggcggcggggccgagctctcaccacgctccgccgccggacttgccgcccccggcggcgaggccgccgatgaggagcggcatcgggtcgagctggaccggcgacatctgttcggccttctgcggcagcaaccacatcccggagacggcggcgcagcgctgccgggacgccggcgcggcattgccgccggagcggccgcgccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgaggatgctgaatgcgaggcaaccgaagagaccaaatcgtcgtcgcggcgatatggatcaaagaggagaactcgtgcagctgaagttcataacctgtcagagaggagaagaagggatcggatcaacgagaagatgcgcgcattgcaagaactcatacctcattgcaacaagaccgacaaggcatctatattagatgaagcaatcgagtatctgaagtcactccaaatgcaagttcagatcatgtggatgactactgggatggcaccaatgatgttccctggtgctcaccagttcatgccaccaatggccgtgggcatgaattctgcgtgcatgcctgcggcacaaggcctaagtcacatgtcaagattgccatacatgaaccattctatgccaaatcacatccctctaaattcatctccagctatgaacccaatgaatgttgcaaaccagatgcagaacattcaactgagagaggcaagcaatcccttccttcacccagatggctggcaaacagtgccaccacaggtatcaggaccatatgcttctgggcctcaagtagcacagcaaaaccagataccgaaagcgtcagctagcactgttctgccaaattctggggctgaacaaccaccaacctctgatggaatt

SEQ ID NO: 717 - protein, 410 aa, Oryza sativa
  LOC_Os03g56950.3 polypeptide
MAICSTDNELVELLWHNGGVVAQPQAAQARVVSSSGRGQSASVLTGDDTETAAWFPDTLDDALEKDLYTQLWRSVTGDAFPAAAAAGPSSHHAPPPDLPPPAARPPMRSGIGSSWTGDICSAFCGSNHIPETAAQRCRDAGAALPPERPRRSSTHDGAGTSSSGGSGSNFGASGLPSESASAHKRKGREDSDSRSEDAECEATEETKSSSRRYGSKRRTRAAEVHNLSERRRRDRINEKMRALQELIPHCNKTDKASILDEAIEYLKSLQMQVQIMWMTTGMAPMMFPGAHQFMPPMAVGMNSACMPAAQGLSHMSRLPYMNHSMPNHIPLNSSPAMNPMNVANQMQNIQLREASNPFLHPDGWQTVPPQVSGPYASGPQVAQQNQIPKASASTVLPNSGAEQPPTSDGI

SEQ ID NO: 718 - DNA, 1230 bp, Oryza sativa; identical to SEQ ID NO: 716
  LOC_Os03g56950.4

SEQ ID NO: 719 - protein, 410 aa, Oryza sativa; identical to SEQ ID NO: 717
  LOC_Os03g56950.4 polypeptide

SEQ ID NO: 720 - DNA, 1263 bp, Oryza sativa; identical to SEQ ID NO: 714
  LOC_Os03g56950.2

SEQ ID NO: 721 - protein, 421 aa, Oryza sativa; identical to SEQ ID NO: 715
  LOC_Os03g56950.2 polypeptide

SEQ ID NO: 722 - DNA, 1167 bp, Oryza sativa
  LOC_Os03g56950.7
atggatggcaatgcgagatcggcggcgaatcagacgaagcaaatcgtcacggacaacgagctggtggagctgctatggcacaacggcggcgtcgtggcgcagccgcaggcggcgcaggcgagggtcgtctcctcctccggccgcggccagagcgccagcgtgctcaccggcgacgacacggagaccgccgcgtggttcccggacaccctcgacgacgcgctggagaaggacctctacacgcagctctggcgcagcgtcaccggcgacgcgttcccggcggccgcggcggcggggccgagctctcaccacgctccgccgccggacttgccgcccccggcggcgaggccgccgatgaggagcggcatcgggtcgagctggaccggcgacatctgttcggccttctgcggcagcaaccacatcccggagacggcggcgcagcgctgccgggacgccggcgcggcattgccgccggagcggccgcgccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgaggatgctgaatgcgaggcaaccgaagagaccaaatcgtcgtcgcggcgatatggatcaaagaggagaactcgtgcagctgaagttcataacctgtcagagaggagaagaagggatcggatcaacgagaagatgcgcgcattgcaagaactcatacctcattgcaacaagaccgacaaggcatctatattagatgaagcaatcgagtatctgaagtcactccaaatgcaagttcagatcatgtggatgactactgggatggcaccaatgatgttccctggtgctcaccagttcatgccaccaatggccgtgggcatgaattctgcgtgcatgcctgcggcacaaggcctaagtcacatgtcaagattgccatacatgaaccattctatgccaaatcacatccctctaaattcatctccagctatgaacccaatgaatgttgcaaaccagatgcagaacattcaactgagagaggcaagcaatcccttccttcacccagatggctggcaaacagtgccaccacaggaccatatgcttctgggcctcaag

SEQ ID NO: 723 - protein, 389 aa, Oryza sativa
  LOC_Os03g56950.7 polypeptide
MDGNARSAANQTKQIVTDNELVELLWHNGGVVAQPQAAQARVVSSSGRGQSASVLTGDDTETAAWFPDTLDDALEKDLYTQLWRSVTGDAFPAAAAAGPSSHHAPPPDLPPPAARPPMRSGIGSSWTGDICSAFCGSNHIPETAAQRCRDAGAALPPERPRRSSTHDGAGTSSSGGSGSNFGASGLPSESASAHKRKGREDSDSRSEDAECEATEETKSSSRRYGSKRRTRAAEVHNLSERRRRDRINEKMRALQELIPHCNKTDKASILDEAIEYLKSLQMQVQIMWMTTGMAPMMFPGAHQFMPPMAVGMNSACMPAAQGLSHMSRLPYMNHSMPNHIPLNSSPAMNPMNVANQMQNIQLREASNPFLHPDGWQTVPPQDHMLLGLK

SEQ ID NO: 724 - DNA, 1482 bp, Oryza sativa
  LOC_Os03g43810.1
atgaaccagttcgtccctgattggagcaacatgggtgacgcatccaggacactcggcgaagatgacaacctcattgagctgctctggtgcaacggccatgtcgtcatgcagagccagaatcaccaccggaagctgccgccgaggccgccggagaaggcggcggcggcggcggtgcaagaagacgaggccggcctgtggttcccgttcgcgctcgccgactcgctggagaaggacatcttctcggacctcttctacgaggcgcccgtcgcggcgacggcggaggcggcgcctgctggcccgggcgcgggcgccgacggcgaaggaaagacttgcaagggcgacgcggcaatggcggaggaggagcgtggcgggccgggcgcggcgtccgaggcgccgcgcgagctgatgccgccgcccaagtcgacgaacgcgtcctgctcgaggcagcagacgatgagcctggcggacggcggcgacaacgccggggacctgtcggagctcgtccgggcgaggaggtcgtccggcggcgcggctcggcggaaggcggaggccggcggcggcggcggcggcgcgtcgtcgtcgatgctgagcgcgatcgggtcgagcatctgcgggagcaaccaggtgcaggtgcagcagcgcacggcgagcgagcccgggcgccgcggcgcgccgccctcggcggtggggagcgcgaacgccatcccctgcggcgggcgcgaccacggccacggccacgaggcgaccaccgtggcgtcgtcgtcggggcggtccaactgctgcttcggcaccaccaccaccacggagccgacgagcaccagcaaccggagcagcaagcgcaagcggctcgacaccaccgaggactccgagagccccagcgaggacgcggagtcggagtcggcggcgctggcgcgcaagccgccggcgaagatgacgacggcgcggaggagccgcgccgccgaggtgcacaacctctccgagaggaggagacgggacaggatcaacgagaagatgagagccctgcaggagctcataccacactgcaacaagactgacaaggcgtcgatgctggacgaggcgatcgagtacctcaagtctctgcagctgcagctgcagatgatgtggatggggagcgggatggcgccgccggtgatgttcccgggggtgcaccagtatctgccgaggatgggcgtcgggatgggggcggcggcggcggcgatgccgaggatgccgttcatggcggcgccgcagccggtggtgcccacaccgccggtgaaccaccttgacctgggcgtcaaccacctgcagccgccgccgacccagggagtggggtattatccgttgggggccaaggccgtgcagcagcagcaaaatccaccacttcacgtgccaaatggaagcattatgcctcctcctgaaaatgcacccaacacaggatcaggtatgggatccttctacttctacttctacttctcttccgat

SEQ ID NO: 725 - protein, 494 aa, Oryza sativa
  LOC_Os03g43810.1 polypeptide
MNQFVPDWSNMGDASRTLGEDDNLIELLWCNGHVVMQSQNHHRKLPPRPPEKAAAAAVQEDEAGLWFPFALADSLEKDIFSDLFYEAPVAATAEAAPAGPGAGADGEGKTCKGDAAMAEEERGGPGAASEAPRELMPPPKSTNASCSRQQTMSLADGGDNAGDLSELVRARRSSGGAARRKAEAGGGGGGASSSMLSAIGSSICGSNQVQVQQRTASEPGRRGAPPSAVGSANAIPCGGRDHGHGHEATTVASSSGRSNCCFGTTTTTEPTSTSNRSSKRKRLDTTEDSESPSEDAESESAALARKPPAKMTTARRSRAAEVHNLSERRRRDRINEKMRALQELIPHCNKTDKASMLDEAIEYLKSLQLQLQMMWMGSGMAPPVMFPGVHQYLPRMGVGMGAAAAAMPRMPFMAAPQPVVPTPPVNHLDLGVNHLQPPPTQGVGYYPLGAKAVQQQQNPPLHVPNGSIMPPPENAPNTGSGMGSFYFYFYFSSD

SEQ ID NO: 726 - DNA, 1686 bp, Zea mays
  GRMZM2G165042_T01
atgaaccagttcgtccctgattggagcaacatgggagacacctccaggccgctcggcgaagaagacgacctcatcgagctgctatggtgcaacggccatgtcgtcatgcagagccagagccaccggaaggtgccgccgaggccggagaaggcggcggcagtggcggctccaccagcccccgcgtccgtgccgcaggaagacgagggcggcctgtggttccccttcgcgctggccgactcgctggacaaggacatcttctcggagttcttctgcgaggcaccgacgccggcaccggcggcggcggatgcggcgccggcggcctctggtggtggaaccggcaccgaagccggcggcaagtcgtgcggcggggacgtcccagtcccagcagaggacgacaggcgcggcggcggcggggcgtgcgcggtgtcggcgggggacccgtgcgacctgatgccgcctcccaagtcgacgcccgcgtcctgctccaggcagcagacgacgatgagcctggccaacggcggcgacaatgccggaggggacctgccgggcctcgtccgtgcgggggcggaggccggcgcgtcgtcgatgctgagcgcgatcgggtccagcatctgcgggagcaaccaggtcctggtgcagcgcgcggcgtgcgcgccggggcgcgcgtccgcgtccggctccggaaccgcccgcggcgacgggtccgggtccgccgcgctgccgtcggcggtgggcagcgcgaacgcgaacgccgtgggcggcggcaggggccacgaggcgtcctcgtcggggcggtccaactactgctgcttcggcgccgccaccaccacaaccacaaccaccaccacggagcccgcgagcaccagcaaccggagcagcaagcgcaagcggctcgacaccgaggactcggagagtcccagcgaggacgcggagtcggggtccgccgcgatgttggcgcgcaagccgccgcagaagatgacgacggcgcggaggagccgcgccgccgaagtgcacaacctgtcggagcggaggagacgagacaggataaacgagaagatgagagccctgcaagagctcatacctcactgcaacaagacggacaaggcgtcaatgcttgacgaggcgatcgagtacctcaagtcgctgcagctgcaagtgcagatgatgtggatgggcagcgccggcatcgcggcgccgccggcggtgatgttccccggcgtacaccagtacctgcctcggatgggcgtcgggatgggcgcggcagcggcggcggcgctgccgtccatgccgcggctgccgttcatggccccgcaaccggtggtgcccagcgcgccggtgagcgtgggcccggtgccggcctaccggggccacatgcccgcggtgggcatcacggagccgtacgggcactacatcggcgtcaaccacctgcagccggcgccgccgccaccgcaggtccagggcgtgagctactacccgccgccgctgggggcgacggcgaaggccgtgcagcaggctgcagagcttcaccacgtgccggggcccggcggcagcatcatgcccgccggcgccgcacccggagtgctgctcccggagagcgcgcaaggcagagggccaggtacggtgccatgcgctccgcccttctcatcctccgcttcagtttttgggctacaaatgggagcactacga

SEQ ID NO: 727 - protein, 562 aa, Zea mays
  GRMZM2G165042_T01 polypeptide
MNQFVPDWSNMGDTSRPLGEEDDLIELLWCNGHVVMQSQSHRKVPPRPEKAAAVAAPPAPASVPQEDEGGLWFPFALADSLDKDIFSEFFCEAPTPAPAAADAAPAASGGGTGTEAGGKSCGGDVPVPAEDDRRGGGGACAVSAGDPCDLMPPPKSTPASCSRQQTTMSLANGGDNAGGDLPGLVRAGAEAGASSMLSAIGSSICGSNQVLVQRAACAPGRASASGSGTARGDGSGSAALPSAVGSANANAVGGGRGHEASSSGRSNYCCFGAATTTTTTTTTEPASTSNRSSKRKRLDTEDSESPSEDAESGSAAMLARKPPQKMTTARRSRAAEVHNLSERRRRDRINEKMRALQELIPHCNKTDKASMLDEAIEYLKSLQLQVQMMWMGSAGIAAPPAVMFPGVHQYLPRMGVGMGAAAAAALPSMPRLPFMAPQPVVPSAPVSVGPVPAYRGHMPAVGITEPYGHYIGVNHLQPAPPPPQVQGVSYYPPPLGATAKAVQQAAELHHVPGPGGSIMPAGAAPGVLLPESAQGRGPGTVPCAPPFSSSASVFGLQMGALR

SEQ ID NO: 728 - DNA, 1284 bp, Setaria italica
  Si035818m
atggatggtaatgcgagaccggcggcgaatcagaggaagcccatcgtcacggacgacgacctcgtggagctcctgtggcacaacgggggcgtcgtcgcgcagccccaggcgcaccagcggccggcgccctccgaacgcctggacagcagcggtctcaccgacgaggagaccgccgcgtggttcccggacaccctcgacgactcgctggagaaggacctgtacacgcagctctggtacagcaccatcgccgacgccgccccgcatcacgggggcacgctcccgggccctagctcgcagccgccgccgccgccaccggagctggcgcacccggcaaggccgccggtggggagcagcggcgtcgagtcgagctgggccggcgacatctgctcgaccttctgcggcagcaaccaggtgcccatgacgccggcagggatcaacaggggaaaggacgcggcattgcagtcggaggtgccgcgcggtgccggcgcgcacgacggcgccggcgccggcacatcgtcatccggcgggtccggaagcaactatggaggatccgggctgccgagtgacagcggccgtgtccagaaaaagatggggaggtgtagagacgactcggatagtcagagtgaggatgccgagtgtgaggcaactgaggaaaccaaatcatcaaggcgatgcgggacgaagcgcaggactcgcgcagctgaagttcataatctctcagagaggagaagaagagaccggatcaatgaaaagatgcgcgcgttgcaagagctgataccacactgcaacaagactgacaaagcgtcgatattagatgagacaattgagtatctgaagtccctccaaatgcaagttcagatcatgtggatgacttctgggatggcaccgatgatgtttcctggtgctcaccaattcatgccaccaatggctctaggcatgacttcagcttgcatccctgcagcgcaaggactaaatcagatgccaagagtagtaccatacatgaaccttcccctgccaaatcacatccctctgaactcatctccagctatgaatccaatgaattcactgagtgtctcgaaccagatgcaaaatgttcacctcagagaggcaagtaatcacttcattcacccagatggcaggcaaacagtggtacctcaggtaccaggaacccatgtttatggacctgaaataccacaagctgaacataatagggtactggaagtgccagctagtactgtcgtgccaacctctagtgcaggacaaccgcatacttatggtggagtt

SEQ ID NO: 729 - protein, 428 aa, Setaria italica
  Si035818m polypeptide
MDGNARPAANQRKPIVTDDDLVELLWHNGGVVAQPQAHQRPAPSERLDSSGLTDEETAAWFPDTLDDSLEKDLYTQLWYSTIADAAPHHGGTLPGPSSQPPPPPPELAHPARPPVGSSGVESSWAGDICSTFCGSNQVPMTPAGINRGKDAALQSEVPRGAGAHDGAGAGTSSSGGSGSNYGGSGLPSDSGRVQKKMGRCRDDSDSQSEDAECEATEETKSSRRCGTKRRTRAAEVHNLSERRRRDRINEKMRALQELIPHCNKTDKASILDETIEYLKSLQMQVQIMWMTSGMAPMMFPGAHQFMPPMALGMTSACIPAAQGLNQMPRVVPYMNLPLPNHIPLNSSPAMNPMNSLSVSNQMQNVHLREASNHFIHPDGRQTVVPQVPGTHVYGPEIPQAEHNRVLEVPASTVVPTSSAGQPHTYGGV

SEQ ID NO: 730 - DNA, 1284 bp, Setaria italica; identical to SEQ ID NO: 728
  Si035819m

SEQ ID NO: 731 - protein, 428 aa, Setaria italica; identical to SEQ ID NO: 729
  Si035819m polypeptide

SEQ ID NO: 732 - DNA, 1596 bp, Setaria italica
  Si035110m
atgaaccagttcgtgcctgattggagcaacatgggagacacctccaggccgctcggcgaagacgatgacctcatcgagctgctctggtgcaacggccatgtcgtcatgcagagccagaacaaccggaagctaccgccgaggcccgagaaggcggcggcgggggcggcagctccagcccccgcgccggcgccgcaagacgacgaggccggcctctggttcccgttcgcgctggccgactcgctcgacaaggacatcttctcggagttcttctgtgaagcaccgccgccgccgccgccgccggctccggtgcccgcaaccacggacgtcgaggccggcaagccctgccgggacgacgacgtgccgttggaggacgactgcgggcgcgtcggggcgtgcgcggtgtccgatgccccgtgcgacctgatgccgccgcccaagtcgacgcacgtgtcgggatccaggcagcagacgatgagcctggcggacagcggcgacaacgccggcgacctctcggacctcgtccgcgcgggcagcgcggggaaggcggcggtggaggccggcgcgtcgtcgatgctgagcgcgatcgggtccagcatctgcgggagcaaccaggtgctggtgcagcgcgcggtgagcgcgccggggcgcgcgtccggcgccgcccgcggcggcggctgcggagggggatgctccggcagcgcgctgccgtcggcgatggggagcgcgaacgccaacgccagcggcaggggcaacgaggccacggtggcgtcctcgtcggggcggtccaactactgcttcggcaccaccaccaccaccgagccgacgagcaccagcaaccggagcagcaagcgcaagcggctcgacaccgaggactcggagagccccagcgaggacgccgagtcggagtccgccgcgatgctggcgcgcaagctgccgcagaagctgacgacggcgcggaggagccgcgccgccgaggtgcacaacctctccgagaggaggagacgagacaggatcaacgagaagatgagagccctgcaagagctcatacctcactgcaacaagaccgacaaggcgtcaatgctggacgaggccatcgagtacctcaagtcgctgcagctgcaggtgcagatgatgtggatgggcagcggcatcgcggcgccgccggtgatgttccccggcgtgcaccagtacctgccgcggatgggcgtcgggatgggcgccgcggcgatgccatccatgccgcggatgccgttcatggccccgcagccggtggtgcccaacgcgcccgtcaaccccgtcccgctctcgccgggctaccgggggcacatgccggcggtgggcatcaccgagccctacgcgcactacctcggcgtcaaccacctccagccgacgccgtcccaggtgtttgggcagcatttcgcgcagggcgtgggatactacccgctgggggcgaaggccgccgtgcagcagaatccggcgatccaccacgtgccgggcggcggcatgccggccgccgccgccgccgcgcccggggcgctgccccctgaaagcgctccgagcagaggaccaggtacaatgcccacggctctgctctcc

SEQ ID NO: 733 - protein, 532 aa, Setaria italica
  Si035110m polypeptide
MNQFVPDWSNMGDTSRPLGEDDDLIELLWCNGHVVMQSQNNRKLPPRPEKAAAGAAAPAPAPAPQDDEAGLWFPFALADSLDKDIFSEFFCEAPPPPPPPAPVPATTDVEAGKPCRDDDVPLEDDCGRVGACAVSDAPCDLMPPPKSTHVSGSRQQTMSLADSGDNAGDLSDLVRAGSAGKAAVEAGASSMLSAIGSSICGSNQVLVQRAVSAPGRASGAARGGGCGGGCSGSALPSAMGSANANASGRGNEATVASSSGRSNYCFGTTTTTEPTSTSNRSSKRKRLDTEDSESPSEDAESESAAMLARKLPQKLTTARRSRAAEVHNLSERRRRDRINEKMRALQELIPHCNKTDKASMLDEAIEYLKSLQLQVQMMWMGSGIAAPPVMFPGVHQYLPRMGVGMGAAAMPSMPRMPFMAPQPVVPNAPVNPVPLSPGYRGHMPAVGITEPYAHYLGVNHLQPTPSQVFGQHFAQGVGYYPLGAKAAVQQNPAIHHVPGGGMPAAAAAAPGALPPESAPSRGPGTMPTALLS

SEQ ID NO: 734 - DNA, 1026 bp, Arabidopsis thaliana
  MYB111 (AT5G49330.1 or G1640)
atgggaagggctccgtgttgtgagaaaatcgggttgaagagagggagatggacagccgaggaagatgagatcctcaccaagtatattcagaccaatggtgaaggttcttggcgatctttgcctaagaaagctggattgttgagatgtggaaagagctgtagactaaggtggataaactacttaagaagagacttaaaaagaggaaatattacttccgacgaagaagaaataatcgtcaagttgcattcccttctcggcaacagatggtcacttattgcaacacatctaccaggaagaacagacaacgaaattaaaaactattggaactcacatctcagccgcaaaatctatgccttcactgccgtttccggagatggacacaatctactcgtcaacgatgtagtcttgaagaaatcttgttcatcgtcttctggagccaagaacaataacaagaccaagaagaagaagaagggaaggactagtaggtcatccatgaagaaacacaagcaaatggtgacggcctcacaatgtttctcacaacctaaggagctagagagtgatttcagtgagggagggcaaaatggtaattttgaaggagagtctttggggccttatgagtggttggatggtgagttagaacggctcttgagtagttgtgtctgggaatgcactagtgaagaggctgtgattggagtaaatgatgaaaaggtgtgtgagagtggggacaatagtagttgttgtgttaatttgtttgaagaagaacaaggaagcgagacaaagattggtcacgtaggaatcacagaggttgatcatgatatgacggtggaaagagaaagagagggaagttttttaagttcgaattcaaatgaaaataatgataaagattggtgggttggtctatgtaattcttcagaagttgggtttggggttgatgaggagttgcttgattgggagtttcaaggtaatgtcacttgtcaaagtgatgatctatgggatctctcagatattggagagataacattggag

SEQ ID NO: 735 - protein, 342 aa, Arabidopsis thaliana
  AT5G49330.1 polypeptide
MGRAPCCEKIGLKRGRWTAEEDEILTKYIQTNGEGSWRSLPKKAGLLRCGKSCRLRWINYLRRDLKRGNITSDEEEIIVKLHSLLGNRWSLIATHLPGRTDNEIKNYWNSHLSRKIYAFTAVSGDGHNLLVNDVVLKKSCSSSSGAKNNNKTKKKKKGRTSRSSMKKHKQMVTASQCFSQPKELESDFSEGGQNGNFEGESLGPYEWLDGELERLLSSCVWECTSEEAVIGVNDEKVCESGDNSSCCVNLFEEEQGSETKIGHVGITEVDHDMTVEREREGSFLSSNSNENNDKDWWVGLCNSSEVGFGVDEELLDWEFQGNVTCQSDDLWDLSDIGEITLE

SEQ ID NO: 736 - DNA, 1113 bp, Arabidopsis thaliana
  AT2G47460.1
atgggaagagcgccatgttgcgagaaggtcggtatcaagagagggcggtggacggcggaggaggaccagattctctccaactacattcaatccaacggtgaaggttcttggagatctctccccaaaaatgccggattaaaaaggtgtggaaagagctgtagattgagatggataaactatctaagatcagacctcaagcgtggaaacataactccagaagaagaagaactcgttgttaaattgcattccactttgggaaacaggtggtcactaatcgcgggtcatctaccagggagaacagacaacgaaataaaaaattattggaactctcatctcagccgtaaactccacaacttcattaggaagccatccatctctcaagacgtctccgccgtaatcatgacgaacgcttcttcagcgccaccgccgccgcaggcaaaacgcagacttgggagaacgagtaggtccgctatgaaaccaaaaatccacagaacaaaaactcgtaaaacgaagaaaacgtctgcaccaccggagcctaacgccgatgtagctggggctgataaagaagcattaatggtggagtcaagtggagccgaggctgagctaggacgaccatgtgactactatggagatgattgtaacaaaaatctcatgagcattaatggcgataatggagttttaacgtttgatgatgatatcatcgatcttttgttggacgagtcagatcctggccacttgtacacaaacacaacgtgcggtggtgatggggagttgcataacataagagactctgaaggagccagagggttctcggatacttggaaccaagggaatctcgactgtcttcttcagtcttgtccatcggtggagtcgtttctcaactacgaccaccaagttaacgatgcgtcgacggatgagtttatcgattgggattgtgtttggcaagaaggtagtgataataatctttggcatgagaaagagaatcccgactcaatggtctcgtggcttttagacggtgatgatgaggccacgatcgggaatagtaattgtgagaactttggagaaccgttagatcatgacgacgaaagcgctttggtcgcttggcttctgtca

SEQ ID NO: 737 - protein, 371 aa, Arabidopsis thaliana
  AT2G47460.1 polypeptide
MGRAPCCEKVGIKRGRWTAEEDQILSNYIQSNGEGSWRSLPKNAGLKRCGKSCRLRWINYLRSDLKRGNITPEEEELVVKLHSTLGNRWSLIAGHLPGRTDNEIKNYWNSHLSRKLHNFIRKPSISQDVSAVIMTNASSAPPPPQAKRRLGRTSRSAMKPKIHRTKTRKTKKTSAPPEPNADVAGADKEALMVESSGAEAELGRPCDYYGDDCNKNLMSINGDNGVLTFDDDIIDLLLDESDPGHLYTNTTCGGDGELHNIRDSEGARGFSDTWNQGNLDCLLQSCPSVESFLNYDHQVNDASTDEFIDWDCVWQEGSDNNLWHEKENPDSMVSWLLDGDDEATIGNSNCENFGEPLDHDDESALVAWLLS

SEQ ID NO: 738 - DNA, 1029 bp, Arabidopsis thaliana
  AT3G62610.1
atgggaagggcgccgtgctgtgagaaggtaggaattaagaaggggcgctggacggcggaggaagaccggactctctccgactacattcagtccaacggcgaaggatcatggcgttctcttcccaaaaatgccgggctaaagagatgtggaaagagctgtagattgagatggataaactatttgagatcagacatcaagagaggaaacataactcccgaagaagaggacgtcattgttaaactgcattccactttgggaaccaggtggtcaacaattgcgagcaatctaccgggaagaacagacaacgaaataaaaaactattggaattctcatctcagccgtaaactccacggttacttcagaaaaccaactgtcgccaataccgtcgagaatgcgcctccgcctcctaagcgtagacctggaagaaccagcagatccgccatgaaacccaaatttatcctaaaccctaaaaaccacaaaacccctaattcttttaaagcaaacaaaagtgacatcgttttgccaactacgacaatagagaatggagagggagacaaagaagacgcattaatggtgttgtcaagtagtagcttaagtggagcagaggaacccggtttaggaccatgtggttatggagacgatggcgattgtaacccaagcattaatggcgacgatggagctttgtgtctcaatgacgacattttcgattcttgttttctattggacgactctcatgctgtccacgtgtcctcatgtgagtcgaacaacgtaaaaaactctgagccatatggagggatgtcagttgggcacaaaaatatcgaaacgatggctgatgatttcgttgactgggactttgtatggagagaaggtcaaaccctttgggacgaaaaagaggatcttgattcggttttgtcgaggctgttagatggagaggaaatggaatctgagatcagacaaagggactccaacgactttggagaaccgttggatattgacgaagaaaacaagatggctgcttggcttttgtct

SEQ ID NO: 739 - protein, 343 aa, Arabidopsis thaliana
  AT3G62610.1 polypeptide
MGRAPCCEKVGIKKGRWTAEEDRTLSDYIQSNGEGSWRSLPKNAGLKRCGKSCRLRWINYLRSDIKRGNITPEEEDVIVKLHSTLGTRWSTIASNLPGRTDNEIKNYWNSHLSRKLHGYFRKPTVANTVENAPPPPKRRPGRTSRSAMKPKFILNPKNHKTPNSFKANKSDIVLPTTTIENGEGDKEDALMVLSSSSLSGAEEPGLGPCGYGDDGDCNPSINGDDGALCLNDDIFDSCFLLDDSHAVHVSSCESNNVKNSEPYGGMSVGHKNIETMADDFVDWDFVWREGQTLWDEKEDLDSVLSRLLDGEEMESEIRQRDSNDFGEPLDIDEENKMAAWLLS

SEQ ID NO: 740 - DNA, 1014 bp, Glycine max
  Glyma02g01740.1
atgggaagggctccttgttgtgagaaagtgggattgaagaaggggaggtggacagcagaggaggatgagatcttggcaaaatacattcaggccaatggggaaggttcttggaggtcattgcctaaaaatgcaggattattaaggtgtgggaagagttgcaggctgagatggattaactatttgagagctgaccttaaaagaggaaacatttctgctgaagaggaaaataccattgttaagttgcacgcttcttttggtaacaggtggtctttgatagcaaatcacttaccaggaagaacagacaacgagataaaaaactactggaattctcacctcagcaggaaaatttacagtttcccaggtgcaggtgcaggtgcaagtgcagggatcatggatacacctaaggtagtatatattcctcccaagcgcaaatgtggtagaacaagtcgttgggccatgaagaaaaacaaaacatacacccaaaaaaacagtgacaccgcagttccgacgccaccaactccgtctctagagagtgagggtttgtcaaacgccgttaatgacttcaaggtcctggacggtgacgtggcagagtttgatgagccgagaacggaggagctggaggcggaggtaaataaacacatcttgggactgtgtgaactagagggcattaatgaggacagtgggatgttgttgggttttagtgacattttggaaagttgccttgcggaaacaacatgtggggtttgggacataagtgaagagagagaaagcaatgacgtggtggcggctgatgcttgtcgcgacaaaatagcatcgagtgaggaagggtcatgctcttccatgaatcaagactgggactgggagagcgtgttagagtttagtaacgctgttgataattgggaggaccaagacaaattgctcacttggctgtgggaggacgatgactgcaagagattgggagagacagatactcagatactacaaaacgacatggttattgattggtttctctct

SEQ ID NO: 741 - protein, 338 aa, Glycine max
  Glyma02g01740.1 polypeptide
MGRAPCCEKVGLKKGRWTAEEDEILAKYIQANGEGSWRSLPKNAGLLRCGKSCRLRWINYLRADLKRGNISAEEENTIVKLHASFGNRWSLIANHLPGRTDNEIKNYWNSHLSRKIYSFPGAGAGASAGIMDTPKVVYIPPKRKCGRTSRWAMKKNKTYTQKNSDTAVPTPPTPSLESEGLSNAVNDFKVLDGDVAEFDEPRTEELEAEVNKHILGLCELEGINEDSGMLLGFSDILESCLAETTCGVWDISEERESNDVVAADACRDKIASSEEGSCSSMNQDWDWESVLEFSNAVDNWEDQDKLLTWLWEDDDCKRLGETDTQILQNDMVIDWFLS

SEQ ID NO: 742 - DNA, 909 bp, Glycine max
  Glyma03g37640.1
atggtaagggctccttgttgtgagaaagtgggattgaagaagggaaggtggacagaggaggaagatgatattttgaccaagtacattcaggccaatggagaaggttcgtggagatcattgccgacaaattcaggattgttgagatgtgggaagagttgcaggctaaggtggattaactatctgagagccgatctcaaaagagggaacatttcttttgaggaggaaagtatcattctgaagttgcatgcttcgtttggcaacaggtggtcgttgatagcaagtcacttgcccggaagaacagacaacgagataaaaaactactggaactctcacttgagcagaaaaatttacacatttcatgggacaacttcgacttctaaagacatcatcattaccctacctcctaggcgcaaacgtggtaggtccagccgctgggccatgaagaagaacaaacaacaacaaattcacactactcacaataacgaagaacaatttgatgggtcgtcgactgctaaagaagaagaagaacaaaacgtaggtgttgaagaaggtgagaaagaagaaataataaatgaagacatatggggaccgtgtgatgaggaagttattaacgggggagaggaagcaagtggggtttggaccatttctgatcatgaacaaagggagagcaatgataatattaatgtggcggggaatgaaaaaggtgttgacgacacgtgtaccaacatagtgatgtctagtggggatgatgatcagttgcattcttcctctttcatggcttcgggcttggatcaaaacctcctcacttggctgtgggaagatgaagactgggagacggatcttcagagccttggagagattcatagtgacaaattaaaagctatggttgattggtttctctcttcaagt

SEQ ID NO: 743 - protein, 303 aa, Glycine max
  Glyma03g37640.1 polypeptide
MVRAPCCEKVGLKKGRWTEEEDDILTKYIQANGEGSWRSLPTNSGLLRCGKSCRLRWINYLRADLKRGNISFEEESIILKLHASFGNRWSLIASHLPGRTDNEIKNYWNSHLSRKIYTFHGTTSTSKDIIITLPPRRKRGRSSRWAMKKNKQQQIHTTHNNEEQFDGSSTAKEEEEQNVGVEEGEKEEIINEDIWGPCDEEVINGGEEASGVWTISDHEQRESNDNINVAGNEKGVDDTCTNIVMSSGDDDQLHSSSFMASGLDQNLLTWLWEDEDWETDLQSLGEIHSDKLKAMVDWFLSSS

SEQ ID NO: 744 - DNA, 948 bp, Glycine max
  Glyma19g40250.1
atggtaagggctccttgttgtgagaaagtgggattgaagaagggaaggtggacaacggaggaggatgaaattttgaccaagtacattatggccaatggagaaggttcgtggagatcattgccgaaaaatgcaggattgttgagatgcgggaagagttgcaggctaaggtggattaactatctaagagctgatctcaaaagaggaaacttttctgttgaggaggaaagtaccattctgaagttgcatgcttcgtttggcagcagctggtcgttgatagcaagtcatttacctggaagaacagacaacgagataaaaaactactggaactctcatttgagcagaaaaatttacactttccatgggaaaacaacttctaaaggcatcatcaccctacctcctcggcgcaaacgtggtagaaccagccgctgggccatgaagaacaaaaaccaaaagggtagtagtagtacacaacaacaacaacaacaaattcatcatcatctcaataatgaagtagcagttcctctccctccaaaacccccacttgagaccgagaaatatttgtccaccaatataatattaatggaggagcaagttgatgggtcgagcactgctagcgagaaagaagaaatattaaatgacgacatatgggggccgtatgttgaggaagaagcaagtggggtttggaccatttctgatgaacaaagagagagcaatatcaatattgtggttgggaatgaaaaagttgatgacgacatgtgtacgaacgtaattatgtcgagtggggatcatgatcggttgcattcttcctcttccattgcttcggacttggatcaaaacctcctcacttggctgtgggaagatgaagattgggagaaggatcttcagagccttggagagattcatagtgacaaattaaaagctatggttgattggtttctctcttcaagt

SEQ ID NO: 745 - protein, 316 aa, Glycine max
  Glyma19g40250.1 polypeptide
MVRAPCCEKVGLKKGRWTTEEDEILTKYIMANGEGSWRSLPKNAGLLRCGKSCRLRWINYLRADLKRGNFSVEEESTILKLHASFGSSWSLIASHLPGRTDNEIKNYWNSHLSRKIYTFHGKTTSKGIITLPPRRKRGRTSRWAMKNKNQKGSSSTQQQQQQIHHHLNNEVAVPLPPKPPLETEKYLSTNIILMEEQVDGSSTASEKEEILNDDIWGPYVEEEASGVWTISDEQRESNINIVVGNEKVDDDMCTNVIMSSGDHDRLHSSSSIASDLDQNLLTWLWEDEDWEKDLQSLGEIHSDKLKAMVDWFLSSS

SEQ ID NO: 746 - DNA, 1119 bp, Populus trichocarpa
  POPTR_0002s19920.1
atgggaagggcaccttgttgtgaaaaagtgggcttgaagaaagggaggtggactgcagaagaggatgagaaattggccaagtatattcaagctaatggagaagggtcttggaggtcaatgcccaagaatgcagggttactgaggtgtgggaagagttgcagactgagatggattaactatttgagagctgatctgaagagaggaaacatatcgactgaggaggaagagatcatcgtgcaattgcatgcttctttgggcaacagatggtctttgatagccagttacttaccaggaagaacggacaatgagataaagaactactggaattctcatctgagcagaaggatccacagttttagaaggtctgcaagtgaaagtctaccattgatcacggaaacagccaaggagggcgtgttaaccaaaggaaaaggaggtcgagcaggtagatttgcagtaaagaaaaacaaaaatagccacactccaaaagatgccaccagggcgtcgacaaagaaacctctcatggaaaacaataccagtaattgccataattcaaacattgaagtcatgcaattgctgcagacaccagcaatagaaaaagaaaccttgtcaagtgcaatcaatgatacggtaatttgggatccatgtgaagatgataaggaacaaatggacctcgttatgccaagtccctatccagaaactggaagaggaatggtgggttcaaaaaatgacagctcagggccattctatcaaggcattgagaacacactgtgttttgatgaggttacggacaaggagttgctggatccaaatgggggttcgacattaaatgaggagcgacaagatggtctcgtggttcgcagtgaagagagagaaaatggggttttaagtccaaacaaaacagtttatgactccattggttatttgagctcaaatggagagagtggtgagtggcactcgtgttcttcaataagtatatcaggttttgatgattggatctgggatgatgtgatgggaggacatgtcgaaggaggaggagatcatttgattcaagaagacaacatgctatcttgcttgtgggagagcgatcaggtggagtggggaggaggaggcactggacta

SEQ ID NO: 747 - protein, 373 aa, Populus trichocarpa
  POPTR_0002s19920.1 polypeptide
MGRAPCCEKVGLKKGRWTAEEDEKLAKYIQANGEGSWRSMPKNAGLLRCGKSCRLRWINYLRADLKRGNISTEEEEIIVQLHASLGNRWSLIASYLPGRTDNEIKNYWNSHLSRRIHSFRRSASESLPLITETAKEGVLTKGKGGRAGRFAVKKNKNSHTPKDATRASTKKPLMENNTSNCHNSNIEVMQLLQTPAIEKETLSSAINDTVIWDPCEDDKEQMDLVMPSPYPETGRGMVGSKNDSSGPFYQGIENTLCFDEVTDKELLDPNGGSTLNEERQDGLVVRSEERENGVLSPNKTVYDSIGYLSSNGESGEWHSCSSISISGFDDWIWDDVMGGHVEGGGDHLIQEDNMLSCLWESDQVEWGGGGTGL

SEQ ID NO: 748 - DNA, 1251 bp, Populus trichocarpa
  POPTR_0014s11780.1
atgggaagggcaccttgttgtgaaaaggtgggcttgaagaaagggagatggactgcagaagaggatgagaaattgacaaagtatattcaagctaacggagaaggttcttggcggtcattgcccaagaatgcagggttgcttaggtgtggaaagagttgcagattgagatggattaactacttggcagctgacttgaagaggggaaacatatctgctgaggaggaagagatcatcataaatttacatgcttctttgggcaataggtggtctttgatagccagtcacttaccaggaagaacagacaatgagataaagaactactggaactctcatttgagcagaagaatttacagctttagaagacctgtaaatgaaagactaccattgatcatcgaaacagccaagcagggcatgttagccaaaagtggagcaggtagatttgcaataaagaaaaaaaaaattagccaccctcaaaaggatgccatcagggtgccaacaaagagaccacgaaaagaaaataatactggtgatttctctaattcaaatattgaaggcatccaattgccacagacaccagcagcagagaaaaataccctgtcaagtacaatcaatgatacggtgatttgggatccatgtgcagaggacaaggagctaatggaccttgtcgtgacaactccctgtccagaaactggaagagtaatgttgggttcaagtggggagaaagcaaacctggtcatatgccctggtgaagagagaagaagaccgaattcaatttttcaccctagtggaggtgagaaagaaaatgatagcttcggacaattctgtgaaggcatcgaaaatgagatgctgagttttaatgaggtgatgggcaaggagttgctggatccagatggcgattcgagtttaaatgatgagggacaaaatggtctcttggtgcacagtggggagaggcagagtggggtttcgagtcctgacaaaacagtagacgtttttgagtccattggtgatttgagctcgaatggagagagttgtgactggcactcgttttcttcaataagcacgtcaggttttgacgattgtggcgttgattggagctgggatgatgtgatgggaggacaccttgagataggagatgagaccaaagaagagaatatgctatcttggttgtgggagaacgagaagggggaagaggtagtgaactatgagaagcaaaatgccatgctgcttggcttctttcttgatttgcctcaa

SEQ ID NO: 749 - protein, 417 aa, Populus trichocarpa
  POPTR_0014s11780.1 polypeptide
MGRAPCCEKVGLKKGRWTAEEDEKLTKYIQANGEGSWRSLPKNAGLLRCGKSCRLRWINYLAADLKRGNISAEEEEIIINLHASLGNRWSLIASHLPGRTDNEIKNYWNSHLSRRIYSFRRPVNERLPLIIETAKQGMLAKSGAGRFAIKKKKISHPQKDAIRVPTKRPRKENNTGDFSNSNIEGIQLPQTPAAEKNTLSSTINDTVIWDPCAEDKELMDLVVTTPCPETGRVMLGSSGEKANLVICPGEERRRPNSIFHPSGGEKENDSFGQFCEGIENEMLSFNEVMGKELLDPDGDSSLNDEGQNGLLVHSGERQSGVSSPDKTVDVFESIGDLSSNGESCDWHSFSSISTSGFDDCGVDWSWDDVMGGHLEIGDETKEENMLSWLWENEKGEEVVNYEKQNAMLLGFFLDLPQ

SEQ ID NO: 750 - DNA, 1092 bp, Populus trichocarpa
  POPTR_0010s15090.1
atgggaagagcaccatgctgtgagaaagtagggctaaagaaagggagatggacagctgaagaggatgaagtcttaaccaaatacattctagccaacggtgaaggctcgtggaaatcactacctaaaaatgcagggttattaaggtgtggtaagagctgtagactaagatggattaactacttaagagctgacttgaagagagggaacataaccaaagaagaggaagagaccattgttaagttgcatactgctttgggtaatagatggtctttcattgctgctcaattaccaggacgaacagacaatgagataaagaactactggaattctcatttaagcagaaaaatttacagcttcaatcggtataaaaatgatgattctctaccaagcatcatggatatcaccgatgtagcagctgggccatacaagggtagaggtggtagaacaagccggtcatccatgaaaaagcacaaggccacattaatatcattaggtaagcctaagagtcctaaagccatagctcatgaggtaactgaaccagcgagcaaagaaacagcagcgatctcacccaaaggtacaaacagctcattaaagagttcggccactgaaggtccacagaaggaaccagaaaatagaaagaatcttggtgtgcaagtccaagaatcttgcatagacattgctaaaagaattaatgcagctggaatatctcattgccctattaatgacgagaaagagactgaaactttaggaccatatgaatggctagacagtgaaataaagcgccttgaatatgcactgcaacgtcaagttgcagatccttttggaaataatacagttgtgacattagagacagacaatgaggcaccgagtatgagcaaggagagcgaaaattataatggggtaatgggaccaaaaagggtggccgtccattacctgaaaaaacaaagcaacagcagcaatggttgtagctcaaatgaagagagtaacggggaatggtacaatagcttttcacctatgaatccaaggtttgatgaggaatggcttgattgggactggacaatagctggggatcttggtgggtggggattgtta

SEQ ID NO: 751 - protein, 364 aa, Populus trichocarpa
  POPTR_0010s15090.1 polypeptide
MGRAPCCEKVGLKKGRWTAEEDEVLTKYILANGEGSWKSLPKNAGLLRCGKSCRLRWINYLRADLKRGNITKEEEETIVKLHTALGNRWSFIAAQLPGRTDNEIKNYWNSHLSRKIYSFNRYKNDDSLPSIMDITDVAAGPYKGRGGRTSRSSMKKHKATLISLGKPKSPKAIAHEVTEPASKETAAISPKGTNSSLKSSATEGPQKEPENRKNLGVQVQESCIDIAKRINAAGISHCPINDEKETETLGPYEWLDSEIKRLEYALQRQVADPFGNNTVVTLETDNEAPSMSKESENYNGVMGPKRVAVHYLKKQSNSSNGCSSNEESNGEWYNSFSPMNPRFDEEWLDWDWTIAGDLGGWGLL

SEQ ID NO: 752 - DNA, 1014 bp, Solanum lycopersicum
  Solyc01g079620.2.1
atgggaagaacaccttgttgtgaaaaagtgggcatcaagagaggcagatggactgcagaagaagatcaaattctcactaattatattatttctaatggagaaggctcttggaggtcgttacctaaaaatgccggattattgagatgcggaaagagttgtagactacgatggattaattatttgaggtctgatctcaagagagggaacattacttctcaagaggaagatataattataaagttacatgcaactttgggtaacagatggtctcttatagcagaacatttatcaggtagaacagacaatgagataaaaaactattggaactctcatctaagtcgaaaagttgatagcttaaggataccaagcgatgagaagttacctaaagccgtagttgatttggctaaaaaaggtataccgaagccaattaaaaaatcatcgattagtcgaccaaaaaataaaaagtcaaacttattagaaaaagaagcattgtgttgtacaaatatgccagcttgtgatagtgccatggaattaatgcaagaagatctagcaaagatagaggtgccaaattcttgggcaggacctatagaggccaagggaagccttagttcagatagtgatatcgaatggccaagactcgaggagattatgccagacgtggtgattgatgatgaagataagaacacaaatttcatattgaattgtttcagagaagaagtaacgagcaataatgtagggaatagttattcatgtatcgaggaaggtaataaaaagatatcaagcgacgatgaaaaaatcaaattattaatggattggcaagataatgatgagttagtatggccaacgttaccatgggaattagaaacggatatagttcccagttggccacaatgggacgatactgacactaacttacttcaaaattgcaccaatgataataataattatgaagaagcaacaacaatggaaattaataaccaaaatcatagtaccattgtatcttggcttttgtct

SEQ ID NO: 753 - protein, 338 aa, Solanum lycopersicum
  Solyc01g079620.2.1 polypeptide
MGRTPCCEKVGIKRGRWTAEEDQILTNYIISNGEGSWRSLPKNAGLLRCGKSCRLRWINYLRSDLKRGNITSQEEDIIIKLHATLGNRWSLIAEHLSGRTDNEIKNYWNSHLSRKVDSLRIPSDEKLPKAVVDLAKKGIPKPIKKSSISRPKNKKSNLLEKEALCCTNMPACDSAMELMQEDLAKIEVPNSWAGPIEAKGSLSSDSDIEWPRLEEIMPDVVIDDEDKNTNFILNCFREEVTSNNVGNSYSCIEEGNKKISSDDEKIKLLMDWQDNDELVWPTLPWELETDIVPSWPQWDDTDTNLLQNCTNDNNNYEEATTMEINNQNHSTIVSWLLS

SEQ ID NO: 754 - DNA, 891 bp, Solanum lycopersicum
  Solyc06g009710.2.1
atgggaagaacaccttgttgtgagaaagtaggtcttaagagagggagatggacttcagaagaagatgaaatcctcacaaactatattcaagctaatggtgaaggttcttggaggtcattacccaaaaatgctgggttattaagatgtggaaaaagttgtagactcagatggattaattatttgaagagtgatttgaagagaggtaacataacctctgatgaagaagctataatcatcaagttacgtgcaactttgggtaacaggtggtctctgatagcagaacatttacctggtagaacagacaatgaaataaaaaactattggaattctcatttgagacgaaaggtggatagctttagaattccaggtgatgagaagctaccacaagcagttgttgaattagctaaaaaaggaacacaagtaaaacatattaccaaacgaggacgcagtagaagaaaaataattactagagtgtcaaattctacgaatgaaaatatcgagtttgatcatattgatgaccagatgttatggcatgacgatattgtgccgatggacgctaactatgaagtgctagatcaagattttattacaaattgtttatgggacgatcaaggagaaaatctcgaaataactgatgataatgataataataataataataatgaaatcttaagtgaggataattatggtaagtgggattgggaatatttaagtgaaatattgaataatgaaatatgtggaaatagtactaaagaaacagagcaaaataataataataataatatgtcattatgtgacattaatgacaatgtgcagaactgcatgaacaaagaagcaacacaagaaaatattgatcccatgcagagtgatttggtagcttggcttttgtct

SEQ ID NO: 755 - protein, 297 aa, Solanum lycopersicum
  Solyc06g009710.2.1 polypeptide
MGRTPCCEKVGLKRGRWTSEEDEILTNYIQANGEGSWRSLPKNAGLLRCGKSCRLRWINYLKSDLKRGNITSDEEAIIIKLRATLGNRWSLIAEHLPGRTDNEIKNYWNSHLRRKVDSFRIPGDEKLPQAVVELAKKGTQVKHITKRGRSRRKIITRVSNSTNENIEFDHIDDQMLWHDDIVPMDANYEVLDQDFITNCLWDDQGENLEITDDNDNNNNNNEILSEDNYGKWDWEYLSEILNNEICGNSTKETEQNNNNNNMSLCDINDNVQNCMNKEATQENIDPMQSDLVAWLLS

SEQ ID NO: 756 - DNA, 879 bp, Solanum lycopersicum
  Solyc12g049350.1.1
atggtaagaacaccttgttgtgagaaagtaggtctcaagagagggagatggacaatagaagaagatgaaagactcacaaactatattcaagctaatggtgaaggctcttggaggacattacctaaaaatgctgggttattaagatgcggaaagagttgcagattaagatggattaattatttaaagagtgatttgaagagaggtaacataacttctgaggaagaagctataatcatcaagttacgtgcaactttgggtaacagatggtctctaatagcagaatatttaccacatagaacagataacgagataaaaaattattggaattctcgtttgtgccgaaaagtagaaagcttgaggattccaagtgacgaagagttgccacaagctgtcgtcgaattagccaaaaaaggaaaacaacaacaaattatcaaacaaagacacaaagggaaaacaaaaattagcggttcaaatttcgtaagtgaaactatagttcacactacatcatcaacgccaaatatagagaaagaaaccgtaaatactattccgaatggcgataataatgccacggagttcgatcataacgatgatcaaatgttatggcatgacgatattatgctaatggacgatgaagatgctaagttggaccaagatttcattttcaaatgtttatggagcgaccaaggagaaagttttgaaataatcgaaaataacaataacaataacaataataatgaaatattaaatgtggataatcatggtacccttgatggttgggattgggaatatttagatgaaatgttgaataatgaaatagagaataacaatgtgtcaaatattgatcccatgaatagtgatttggtagcttggcttttgtct

SEQ ID NO: 757 - protein, 293 aa, Solanum lycopersicum
  Solyc12g049350.1.1 polypeptide
MVRTPCCEKVGLKRGRWTIEEDERLTNYIQANGEGSWRTLPKNAGLLRCGKSCRLRWINYLKSDLKRGNITSEEEAIIIKLRATLGNRWSLIAEYLPHRTDNEIKNYWNSRLCRKVESLRIPSDEELPQAVVELAKKGKQQQIIKQRHKGKTKISGSNFVSETIVHTTSSTPNIEKETVNTIPNGDNNATEFDHNDDQMLWHDDIMLMDDEDAKLDQDFIFKCLWSDQGESFEIIENNNNNNNNNEILNVDNHGTLDGWDWEYLDEMLNNEIENNNVSNIDPMNSDLVAWLLS

SEQ ID NO: 758 - DNA, 942 bp, Glycine max
  Glyma07g37140.1
atggggagagctccttgttgtgagaaggtggggttgaagaaaggaagatggacagctgaagaggataagatcttgaccgattacatccaagaaaatggggagggatcatggagttccttgcccaagaatgcaggtttgttaagatgtggaaaaagttgtagactgagatggatcaactacttgagatcagacgtgaagagaggcaacatcactcctcaagaagaagagatcattgtcaagttgcatgctgttcttggtaacaggtggtctgtaatagcaggacatttaccaggtcgcacggacaatgaaataaagaactattggaattcccatttgaggagaaagatttactgcttcatgaagtccttaaatgagtccctccctcccattgacatggctgctgtaaacgtagctgctaaatccaagagaagaaccggtggtcgagttcaaccaatgctcaaaagaagtgcaacttcacaaagtttcaacgatgaggagagcctaacagattatggtttggatgcttattgtgagatgggggacaacacatatgacacaactgcttcatgccccagcatagatgaagttgaggccttgggaccttatcaatggttagatgatgaaatcatgaaacttactcgcatgtttgaaaatggggtgctcgtaaacccaggcggggttttaaccaataatgaagagtggcttattagaaataactttggactaatgggagagggctcatcaaatgcagaaagtggagagtggaacactagctgttcgtcagtgaattctgtctatgactatcatcattatcagtggcctgatatgcaattagaaggtagtgttcaatcctataatccttgggatctttgtgaagaaaaccagaacgtggctaattgcttttggggtactggccataatgaaggaaatggcttttaccag

SEQ ID NO: 759 - protein, 314 aa, Glycine max
  Glyma07g37140.1 polypeptide
MGRAPCCEKVGLKKGRWTAEEDKILTDYIQENGEGSWSSLPKNAGLLRCGKSCRLRWINYLRSDVKRGNITPQEEEIIVKLHAVLGNRWSVIAGHLPGRTDNEIKNYWNSHLRRKIYCFMKSLNESLPPIDMAAVNVAAKSKRRTGGRVQPMLKRSATSQSFNDEESLTDYGLDAYCEMGDNTYDTTASCPSIDEVEALGPYQWLDDEIMKLTRMFENGVLVNPGGVLTNNEEWLIRNNFGLMGEGSSNAESGEWNTSCSSVNSVYDYHHYQWPDMQLEGSVQSYNPWDLCEENQNVANCFWGTGHNEGNGFYQ

SEQ ID NO: 760 - DNA, 807 bp, Glycine max
  Glyma17g03480.1
atgggaagagctccttgctgtgagaaggtggggttgaagaagggaagatggacagctgaagaggataagatcttgactgattacatccaagaaaatggtgagggatcatggaggtccttgcccaagaatgcaggtttgttaagatgtgggaaaagttgtagactgaggtggatcaactacttgagatcagatgtgaagagaggtaacatcactcctcaagaagaagagatcattgtcaagttgcatgctgttctgggtaacaggtggtctgtaatagcaggacatttaccaggtcgcacggacaatgaaataaagaactattggaattcccatttgaggagaaaaatttactgcttcatgaagtccttaaatgagtccctccctcccattgacatggctgctgtaaacgtagctgctaactccaagagaagaaccgttcaaccaacgctcaaaagaagtgcaacttcacaaagtttcattaatgatgaggagaacccaacagaatatagtttggatggttattgtgagaacacatatggcacaaccgcttcatgcctcagcagcatggatgaagttgaggccttgggaccttaccaatggttagatgatgaaatcatgaaacttactcacatctgttcgtcagtgaattctgtctatgactatcatcatcatcagtggcctgatatgcaattagaaggtagtgttgatcaatcctataatccttgggatttttgtgaagaaaaccagaacgaggctaattgcttttggggtactactggccataatgaaggaaatggcttttaccag

SEQ ID NO: 761 - protein, 269 aa, Glycine max
  Glyma17g03480.1 polypeptide
MGRAPCCEKVGLKKGRWTAEEDKILTDYIQENGEGSWRSLPKNAGLLRCGKSCRLRWINYLRSDVKRGNITPQEEEIIVKLHAVLGNRWSVIAGHLPGRTDNEIKNYWNSHLRRKIYCFMKSLNESLPPIDMAAVNVAANSKRRTVQPTLKRSATSQSFINDEENPTEYSLDGYCENTYGTTASCLSSMDEVEALGPYQWLDDEIMKLTHICSSVNSVYDYHHHQWPDMQLEGSVDQSYNPWDFCEENQNEANCFWGTTGHNEGNGFYQ

SEQ ID NO: 762 - DNA, 933 bp, Glycine max
  Glyma09g04370.1
atggggagatctccttgctgtgagaaagtggggttgaagaaaggaagatggactgcagaagaggataaaatcttaactgattacattcaagaaaatggtgaaggctcgtggaaaatcttgcccaagaatgcaggtttgttgagatgtgggaagagttgtcgactgagatggatcaactatttgagagctgacgtgaagagaggtaacatcactcctgaggaagaagagatcattgtcaagttgcatgctgttcttggtaataggtggtctgtgatagctggacatttaccaggaagaacagacaatgagataaagaactattggaactctcaccttaggagaaagatctattgcttcatgagatctctaaatgaaaacaagccaaccacagaagaggaaaagaacattgctttgagccaaaactcctttgagtcaatgcctagttgcaacagagaagaaggtgaagaaatttccatgatggatgcttgttatgaaatggagggcattacagttagtagcaaagctgcatcataccccagtcttgaagacagcttgggaccatatcatcattggtctgatgatgaaatcatgaaacttagtaacatgtttgaaaatggggtgcttgtgaatccatgtggtaatgatttaacccttaaggaggagcctaatggaaatgaatgtggccagatgaatgtggatgtaatgggaacagatcaaagcaagaacaatggtgtttggaactcatcaaatggagagagtggagaatggtaccccaattgttcatcagtgaattctgtcattgattatcagtggtctgattgggacatgggaggaagtgttcaatccaataatcagtggaatctttgtgatgaccaagtgatgaattgcttgtggagtactggcattggtgaaataaattatggttttcatcca

SEQ ID NO: 763 - protein, 311 aa, Glycine max
  Glyma09g04370.1 polypeptide
MGRSPCCEKVGLKKGRWTAEEDKILTDYIQENGEGSWKILPKNAGLLRCGKSCRLRWINYLRADVKRGNITPEEEEIIVKLHAVLGNRWSVIAGHLPGRTDNEIKNYWNSHLRRKIYCFMRSLNENKPTTEEEKNIALSQNSFESMPSCNREEGEEISMMDACYEMEGITVSSKAASYPSLEDSLGPYHHWSDDEIMKLSNMFENGVLVNPCGNDLTLKEEPNGNECGQMNVDVMGTDQSKNNGVWNSSNGESGEWYPNCSSVNSVIDYQWSDWDMGGSVQSNNQWNLCDDQVMNCLWSTGIGEINYGFHP

SEQ ID NO: 764 - DNA, 885 bp, Glycine max
  Glyma15g15400.1
atgggtagatctccttgctgtgagaaagtggggttgaagaaaggaagatggactgcagaagaggataaaatcttgaccgattacattcaagaaaatggtgaaggctcgtggaaaaccttgcctaagaatgcaggtttgttgaggtgtgggaagagttgccgactgagatggatcaactatttgagagctgacgtgaagagaggtaacatcactcctgaggaagaagagatcattgtcaagttgcatgctgttcttggtaataggtggtctgtgatagctggacgtttaccgggacgaacagacaatgagataaagaactattggaactctcaccttaggagaaagatctattgcttcatgagatctctaaatgagtctcttccacccactgacatggctgctgtaaactctgccacatccaagagaagagttcgcggttcaagaaacaagccagccacagaagaagaaaagaacatggctttgagccaaaactcctttgagtcaatgcctagttgcaacagagaagaaggtgaagaaatttccatgatggatgcttgttatgaaatggagagcattacaattagtagcacatttgcatcatgccccagccttgaagccagcttgggaccatatcatcattggtctgatgatgaaatcatgaaacttagtaacatgtttgaaaatggggtgcttgtgaatccaagtggtaataatgtaacccttaaggatgagcctaatggaattgaatgtggccagatgaattggtctgattgggacatgggaggaagtgttcaatccaataatcagtggaacctttgtgatgaccaagtgatgaattgcttgtggagtactggcattggtgaaataaattatggttttcatcca

SEQ ID NO: 765 - protein, 295 aa, Glycine max
  Glyma15g15400.1 polypeptide
MGRSPCCEKVGLKKGRWTAEEDKILTDYIQENGEGSWKTLPKNAGLLRCGKSCRLRWINYLRADVKRGNITPEEEEIIVKLHAVLGNRWSVIAGRLPGRTDNEIKNYWNSHLRRKIYCFMRSLNESLPPTDMAAVNSATSKRRVRGSRNKPATEEEKNMALSQNSFESMPSCNREEGEEISMMDACYEMESITISSTFASCPSLEASLGPYHHWSDDEIMKLSNMFENGVLVNPSGNNVTLKDEPNGIECGQMNWSDWDMGGSVQSNNQWNLCDDQVMNCLWSTGIGEINYGFHP

SEQ ID NO: 766 - DNA, 951 bp, Oryza sativa
  LOC_Os01g19970.1
atggggagggcgccgtgctgcgagaaggtggggttgaggagggggaggtggacgaaggaggaggacgagaagctggcgaggtacatacgggagaacggggaaggggcgtggaggtcgatgcccaagaatgccggcctgctgcgctgcggcaagagctgcaggcttcggtggatcaactacctccgggccgacctcaagagggggaacatctcgccccaggaggaggacatcatcctcaacctccacgccacactcggcaacaggtggtccctgatcgccggccacttgcccgggcggacggacaatgagatcaagaactactggaactcgcacctgagccggaagggatacgagttcctccgcggcggcggcggcggcgccgtcgtcgacgtcgacctcagcaagttgcccggcggcgggaagcggcgcggcggccggacgggccgcagcagcagcgggaaggagaagacgaggacgaaggagaaggacaaggcccccgctccagaagctgcgcacaatgacgacggcggcggcggcggcggcggcggcattgacaacgtctcggcagctagccacagccacagggaggagcaggcacaggcgagcgccagtggtctcacatcagatgggctcgaggagggcccactgggcctaagcgaggagatggtgagtgggcccgtgggaccggtgagcccaaagcctgaggtgggccaggatgggtcttctgcagagagtggctgctgtgggcctagtggatccagtggcccaaccgaggctgtgggccaggacatgggcgacaagtccatggactgggacctggtgggcctggacgatggcttcgccaacgatgacatgtggggctcactctcctgggactacggggagttggtgggcccggatggagttcatcagggcgaggtgctatccgacttgttcttcttgggcaacctg

SEQ ID NO: 767 - protein, 317 aa, Oryza sativa
  LOC_Os01g19970.1 polypeptide
MGRAPCCEKVGLRRGRWTKEEDEKLARYIRENGEGAWRSMPKNAGLLRCGKSCRLRWINYLRADLKRGNISPQEEDIILNLHATLGNRWSLIAGHLPGRTDNEIKNYWNSHLSRKGYEFLRGGGGGAVVDVDLSKLPGGGKRRGGRTGRSSSGKEKTRTKEKDKAPAPEAAHNDDGGGGGGGGIDNVSAASHSHREEQAQASASGLTSDGLEEGPLGLSEEMVSGPVGPVSPKPEVGQDGSSAESGCCGPSGSSGPTEAVGQDMGDKSMDWDLVGLDDGFANDDMWGSLSWDYGELVGPDGVHQGEVLSDLFFLGNL

SEQ ID NO: 768 - DNA, 1035 bp, Zea mays
  GRMZM2G051256_T01
atggggagggcgccgtgctgcgagaaggtggggctgaagaaggggaggtggaccaaggaggaggacgaggtcctggcgaggtacatcaaggagcacggggaaggatcgtggaggtcactgcccaagaatgccgggctgctgcggtgcgggaagagctgcaggctgcggtggatcaactacctgcgggcgggtctcaagagggggaacatctcggaggaggaggaggacatgatcatcaagctccacgccacgcttggcaacaggtggtccctgatcgccggtcacttgcccggtcgaacagacaacgagatcaaaaactactggaactcgcacctgagcaggcgggcggccgacttccgcgacggcgtcgtcgtcgacatcgacctcagcaagctgcccggcggcgggaaacggcgcggcggccgggccagccggggcgccgtcgtggccgcggccaaggagaagaaggccaaggagaaggacgacaggggcaatagcaaggtcgcagaagcggagcagcagctcagggacacggaggacgacgacggcggcagcgtctccacgccgaggcctcagtctgatgactgcggcaccgcccagagcgaagaggagcaagcgcaggccagcgccagcggcctgacatccgatgggcatgggcccgaggaggaggaggaggaggacccgctggctctgagcgaggagatggtgagtgcgcttctggccccggaaagcccaaagctggaggtgggccccgatggctcgtgcatggacagctacagtggccctccgtcaggggaaagcggctgtgggtccagtgggccttctggcgacgtggcccaggacctggacctagacgacgacaaggccatcatggactgggacttgatggggctggacatctcgaccgccggtgacatgtgggaccagctggtgtgggactacgacgaaacgttggtcacggaaccggaaggaggggaggaagggcaccagcagcaggacgatgtcatgtcagacctcttcttcctggacaatctc

SEQ ID NO: 769 - protein, 345 aa, Zea mays
  GRMZM2G051256_T01 polypeptide
MGRAPCCEKVGLKKGRWTKEEDEVLARYIKEHGEGSWRSLPKNAGLLRCGKSCRLRWINYLRAGLKRGNISEEEEDMIIKLHATLGNRWSLIAGHLPGRTDNEIKNYWNSHLSRRAADFRDGVVVDIDLSKLPGGGKRRGGRASRGAVVAAAKEKKAKEKDDRGNSKVAEAEQQLRDTEDDDGGSVSTPRPQSDDCGTAQSEEEQAQASASGLTSDGHGPEEEEEEDPLALSEEMVSALLAPESPKLEVGPDGSCMDSYSGPPSGESGCGSSGPSGDVAQDLDLDDDKAIMDWDLMGLDISTAGDMWDQLVWDYDETLVTEPEGGEEGHQQQDDVMSDLFFLDNL

SEQ ID NO: 770 - DNA, 999 bp, Zea mays
  GRMZM2G051528_T01
atggggagggcgccgtgctgcgggaaggtggggttgaagaaggggaggtggaccagggaggaggacgagatcctggcgaggtacatcgaggagcacggggaaggctcatggagatcactgcccaagaatgctgggttgctgcggtgcgggaagagctgcaggctgcggtggatcaactacctgagggcgggtctcaagagggggaacatcacggaggaggaggaggacgtgatcgtcaagcttcacgccacgcttggcaacaggtggtccctgatcgccggtcatttgcctggccgaactgacaacgagatcaagaaccactggaactcgcacctgcgcaggcgcgggcgggcgggcgactcccgcgacgacggcgtcgtcgtcaacatcgacctcgtcaagctgcccggcggccgccgggccagcagccgaggcatcgtggccgcggccaagccagctggaaagaacaaggagaagaggaagaacggcaagggcaggaacaacgtagcagaagcggagcagcagctcgaggaggaggacgccaacgtgtcaacaactacgccgaggactcagtctcactgcgcctccgctgcccagagcgaggagcaagcgcaggccagcgctagcggcctgacctccgaggaggacctgctggccctgagcgaggagatggtggtgagtgcgctactggccccgggaagcccgaagctgctggaggtgggccccgacggctcgtgcgtggacggtgacggtggcctgtctggggacagcggccgtgggtcaggcgggccttctggcgatgtggcccaggagctgcacctcgacgacgacgccatcatggactgggactccatggggctggacatcccgaccgccgatgacacgtggaaccccctggtgtgggactacgaccagacgtcgttggtcccggaaccggaaggagaggggcgccggcagcgggacgagatgatgtcagacctcttcttcctcgacaatctc

SEQ ID NO: 771 - protein, 333 aa, Zea mays
  GRMZM2G051528_T01 polypeptide
MGRAPCCGKVGLKKGRWTREEDEILARYIEEHGEGSWRSLPKNAGLLRCGKSCRLRWINYLRAGLKRGNITEEEEDVIVKLHATLGNRWSLIAGHLPGRTDNEIKNHWNSHLRRRGRAGDSRDDGVVVNIDLVKLPGGRRASSRGIVAAAKPAGKNKEKRKNGKGRNNVAEAEQQLEEEDANVSTTTPRTQSHCASAAQSEEQAQASASGLTSEEDLLALSEEMVVSALLAPGSPKLLEVGPDGSCVDGDGGLSGDSGRGSGGPSGDVAQELHLDDDAIMDWDSMGLDIPTADDTWNPLVWDYDQTSLVPEPEGEGRRQRDEMMSDLFFLDNL

SEQ ID NO: 772 - DNA, 1020 bp, Setaria italica
  Si002107m
atggggagggcgccgtgctgcgagaaggtggggctgaagaaggggaggtggacgaaggaggaggacgagatcctggggaggtacatcaaggagcacggggaagggtcatggagatcgctgcccaagaatgctgggctgctgcggtgcgggaagagctgcaggctgcggtggatcaactacctgagggcggatctcaagagggggaacatctcggaggaggaggaggagatgatcatcaagctccacgccacccttggcaacaggtggtccctgatcgccggccacttgcccggccggacggacaacgagatcaagaactactggaactcgcacctgagcaggcgggcggccgacttccgcgacggtgtcgtcgtcaacgtcgacctcagcaagctccccggcggcggcaagcggcgcggcggccgggctagccgcggcatcatggctgccgccaaggcgggcaaggagaagaaggtgaaggagaaagagaaggacaaggggaagaacaaggctgcagaagcggagcagcagctcaagctcgaggaggaggacatggccgtgtcgacaccgagctctcactcccagccgtgcgccactgacaagagcggcgaggagcaagcgcaggccagcgccagtggcgtcacctctgatgatgggcccgaggaggacccgctggccctgagcgaggagatgatgagtgcgcttctgggcccagtaagcccaaagctggaggtgggcccggacggctcgggcatggacagtgacagtggcccgtcgtccctggtcgtggacagcgagagtgggcctggtgggcctacgggggacgtggcccaagagctgggcgagaacgacaaggccatcatggactgggacttgatggcgctggacatctcgaccgccggtgacatgtgggaccccctggtgtgggactacgctgacatggacatcgtggtaccggatggtgggcaccagcagcagcaggaggacgtggtgtcagacctcttcttcctggacaacatg

SEQ ID NO: 773 - protein, 340 aa, Setaria italica
  Si002107m polypeptide
MGRAPCCEKVGLKKGRWTKEEDEILGRYIKEHGEGSWRSLPKNAGLLRCGKSCRLRWINYLRADLKRGNISEEEEEMIIKLHATLGNRWSLIAGHLPGRTDNEIKNYWNSHLSRRAADFRDGVVVNVDLSKLPGGGKRRGGRASRGIMAAAKAGKEKKVKEKEKDKGKNKAAEAEQQLKLEEEDMAVSTPSSHSQPCATDKSGEEQAQASASGVTSDDGPEEDPLALSEEMMSALLGPVSPKLEVGPDGSGMDSDSGPSSLVVDSESGPGGPTGDVAQELGENDKAIMDWDLMALDISTAGDMWDPLVWDYADMDIVVPDGGHQQQQEDVVSDLFFLDNM

SEQ ID NO: 774 - DNA, 1074 bp, Oryza sativa
  LOC_Os03g19120.1
atggggagggcgccgtgctgcgagaaggttgggctgaagcgcgggaggtggacgacggaggaggacgagaagctcgccggctacattgccaagcacggcgagggatcctggcgctcgctgcccaagaatgcagggctgttgcggtgcggaaagagctgcaggctgcggtggatcaactacctgagagccggcgtgaagcgggggaacatctccaatcaggaagaggacgtcatcatcaagctccacgctaccctcgggaacagaaagtcttacgttgtgaaacggatggactacgtgtgtttgggcgcacgtgactactgcttccaacaaaacacacacgtacggtggtccctgatcgcgagccacctcccggggaggacggacaacgagatcaagaactactggaactcgcacctgagcaggcagatccacacgtaccggaggacgtacaccgcccccagcgaggccgccgtgaccatcgacgtgaccaagctccaggccgccgggaagcgccgcggcggccggaccgccgggcagtcgcggaagggcgacaagaagcgcgcggaggacgacccgcccaaggagaccgccgccgccgacacgccgttgccggagtcgagcccgcggcgcgcgcagagcgacgaggcgcggagcggcagcgtggtggtcgacccggaggagccgagcagccagcccaacaacggcagcagcggcggcggcggcggcacgccggacgggccgtgcagcgaggagacagccactgggccgacgtcgctggacccgatggagatgggcctctgggaggttgagagcgagttcgccgagatggaggcccttctgtgcggcggtgtggcgcccgacggccccgggataccggggctcgagccgctggacgtcgcggcccaggcggacgacctgctcgacatggactgggacggcttcgcggccgacctgtggggcgatccggcccagaggggcggccttgtccaagacgcgggcgagccaaacggctcgatgggctgcagctcggacgagctcgagtcgttcgcgagctggctcctctcggactcctgc

SEQ ID NO: 775 - protein, 358 aa, Oryza sativa
  LOC_Os03g19120.1 polypeptide
MGRAPCCEKVGLKRGRWTTEEDEKLAGYIAKHGEGSWRSLPKNAGLLRCGKSCRLRWINYLRAGVKRGNISNQEEDVIIKLHATLGNRKSYVVKRMDYVCLGARDYCFQQNTHVRWSLIASHLPGRTDNEIKNYWNSHLSRQIHTYRRTYTAPSEAAVTIDVTKLQAAGKRRGGRTAGQSRKGDKKRAEDDPPKETAAADTPLPESSPRRAQSDEARSGSVVVDPEEPSSQPNNGSSGGGGGTPDGPCSEETATGPTSLDPMEMGLWEVESEFAEMEALLCGGVAPDGPGIPGLEPLDVAAQADDLLDMDWDGFAADLWGDPAQRGGLVQDAGEPNGSMGCSSDELESFASWLLSDSC

SEQ ID NO: 776 - DNA, 1032 bp, Zea mays
  GRMZM2G022686_T01
atggggagggcgccgtgctgcgagaaggtggggctcaagcgcgggaggtggacgaaggaggaggaccagatactcgccaactacatcgcagagcacggcgagggatcctggaggtcgctgcccaagaatgcagggctgctccgctgcggcaagagctgccgcctgcggtggatcaactaccttcgggccgacgtcaagagggggaacatctccaaggaggaagaggacgtcatcatcaagctccacgccacccttggaaacaggtggtccctgatcgccagccacctccccggccgaacagacaacgagatcaagaactactggaactcgcacctcagccgccagatccacacgtaccgccggaaatacaccgccggcccggacacggcgcccatcgccatcgccatcgccatcgacatgagcaagctgcacagcgccgagaggcggcgcggtggcaggaccccgggccggtcgccgaagagcgccaccagcagcagcagcatgaccaagagcaagcagccggacgaccctgagccagaaccggaggccggcggcgcgtccagcccgcggcacagcgacggggcgcgaagcgccgtggtggacccggacccggacccgaaccagcccaacagcagcagcggcagcggcagcacgggcgagggggaggacgcgacggggccgtgggtgctggatccgatcgagctcggggacctctgggaggccgagagcgagatggacgccctcatgtctatcgggggggctgcccacgactcggccaccgcggaaggattcgacgcggcccaggcccaggtggacgacctgttcgacgacatggactgggataacttcgcggcccatctgtggggggagccggagcagcagaacgaccacagcgcgcagccgcagccccagcaggccgccgagccgcaggctgctgctgctgctgatgtggcggcggcgggggcggaggcctgcgacccggacgaacacgaactggaggcgttggaaacttggctcctgtccgactcgttc

SEQ ID NO: 777 - protein, 344 aa, Zea mays
  GRMZM2G022686_T01 polypeptide
MGRAPCCEKVGLKRGRWTKEEDQILANYIAEHGEGSWRSLPKNAGLLRCGKSCRLRWINYLRADVKRGNISKEEEDVIIKLHATLGNRWSLIASHLPGRTDNEIKNYWNSHLSRQIHTYRRKYTAGPDTAPIAIAIAIDMSKLHSAERRRGGRTPGRSPKSATSSSSMTKSKQPDDPEPEPEAGGASSPRHSDGARSAVVDPDPDPNQPNSSSGSGSTGEGEDATGPWVLDPIELGDLWEAESEMDALMSIGGAAHDSATAEGFDAAQAQVDDLFDDMDWDNFAAHLWGEPEQQNDHSAQPQPQQAAEPQAAAAADVAAAGAEACDPDEHELEALETWLLSDSF

SEQ ID NO: 778 - DNA, 1005 bp, Zea mays
  GRMZM2G057027_T02
atggggagggcgccgtgctgcgagaaggtggggctcaagcgagggaggtggacggcggaggaggaccagttacttgccaactacattgcggagcacggcgaggggtcctggaggtcgctgcccaagaatgcaggcctgctccggtgcggcaagagctgccggctccgttggatcaactaccttcgggcggacgtcaagagggggaacatctccaaggaggaagaagacatcatcatcaagctccacgccaccctcgggaacaggtggtccctgatcgccagccacctccccggccgaacagacaacgagattaagaactactggaactcgcacctcagccggcagatccacacgtaccgccggaaatacaccgccgggccggacgacaccgccatcgccatcgacatgagcaagctgcagagcgccgacaggcggcgcggcggcaggaccccgggccggccgccgaagactagcgccagcaggaccaagcattcagacgccgatcagcccggcggcgaggcgaaaggcgcggcggcgtcgagcccgcggcacagcgacgcggtgaacccgggcccgaaccagcccaacagcagcagcggcagcacgggcacggccgaggaggaagggcccagcagcgaggacgcgagcgggccgtgggtgctggagccgatagagctcggggacctctggggggaggccgacagcgagatggacgccctgatgcctattgggcccggcggccacgactcggctgccctccaagggcttggcgcggtcggcggcgaggcccaggtggacgacctgttcgacatggactgggatggcttcgcggcccatctgtggggcgggccggagcaggacgaccacagcgcgcagctgcggcaggccgccgagccgatggaagcggctgctgttgccgctgccgctgccgctgcgacggcggcctgcaccccggacgatcgcgagctggaggcgttcgagacttggctcctgtccgactcgttc

SEQ ID NO: 779 - protein, 335 aa, Zea mays
  GRMZM2G057027_T02 polypeptide
MGRAPCCEKVGLKRGRWTAEEDQLLANYIAEHGEGSWRSLPKNAGLLRCGKSCRLRWINYLRADVKRGNISKEEEDIIIKLHATLGNRWSLIASHLPGRTDNEIKNYWNSHLSRQIHTYRRKYTAGPDDTAIAIDMSKLQSADRRRGGRTPGRPPKTSASRTKHSDADQPGGEAKGAAASSPRHSDAVNPGPNQPNSSSGSTGTAEEEGPSSEDASGPWVLEPIELGDLWGEADSEMDALMPIGPGGHDSAALQGLGAVGGEAQVDDLFDMDWDGFAAHLWGGPEQDDHSAQLRQAAEPMEAAAVAAAAAAATAACTPDDRELEAFETWLLSDSF

SEQ ID NO: 780 - DNA, 1005 bp, Zea mays
  GRMZM2G084799_T01
atggggagggcgccgtgctgcgagaaggtggggctcaagcgagggaggtggacggcggaagaggaccagttacttgccaactacattgcggagcacggcgaggggtcctggaggtcgctgcccaagaatgcaggcctgctccggtgcggcaagagctgccggctccggtggatcaactaccttcgggcggacgtcaagagggggaacatctccaaggaggaagaagacatcatcatcaagctccacgccaccctcggcaacaggtggtccctgatcgccagccacctccccggccgaacagacaacgagatcaagaactactggaactcgcacctcagccggcagatccacacgtaccgccggaaatacaccgccgggcctgacgacaccgccatcgccatcgacatgagcaagctgcagagcgccgacaggcggcgcggcggcaggaccccgggccggccgccgaaggctagcgccagcaggaccaagcaggcggacgccgatcagcccggcggcgaggcgaaaggcccggccgcggcggcgtcgagcccgcggcacagcgacgtggtgaacccgggcccgaaccagcccaacagcagcagcggcagcacgggcacggccgaggaggaggggcccagcagcgaggacgcgagcgggccgtgggtgctggagccgatagagctcggggacctagtctggggggaggccgacagcgagatggacgccctgatgcctatcgggcccggcggccacgactcggctgccctcgaagggcttggcgcggtcggctgcgaggcccaggtggacgacctgttcgacatggactgggatggcttcgcggcccatctgtggggcgggccggagcaggacgagcacagcgcgcagctgcggcaggccgccgagccgctggaagttgctgctgctgctgctgctgcgacggcggcccgcaccccggacgatcgcgagctggaggcgttcgagacttggctcctgtccgactcgttc

SEQ ID NO: 781 - protein, 335 aa, Zea mays
  GRMZM2G084799_T01 polypeptide
MGRAPCCEKVGLKRGRWTAEEDQLLANYIAEHGEGSWRSLPKNAGLLRCGKSCRLRWINYLRADVKRGNISKEEEDIIIKLHATLGNRWSLIASHLPGRTDNEIKNYWNSHLSRQIHTYRRKYTAGPDDTAIAIDMSKLQSADRRRGGRTPGRPPKASASRTKQADADQPGGEAKGPAAAASSPRHSDVVNPGPNQPNSSSGSTGTAEEEGPSSEDASGPWVLEPIELGDLVWGEADSEMDALMPIGPGGHDSAALEGLGAVGCEAQVDDLFDMDWDGFAAHLWGGPEQDEHSAQLRQAAEPLEVAAAAAAATAARTPDDRELEAFETWLLSDSF

SEQ ID NO: 782 - DNA, 1092 bp, Setaria italica
  Si039538m
atggggagggcgccgtgctgcgagaaggtggggctgaagcgggggaggtggacggcggaggaggacgagatactcgccaactacattgccaagcacggagaggggtcctggaggtcgctgcccaagaatgcagggctgcttcgctgtggcaagagctgccggctgcggtggatcaactacctccgggcggacgtgaagagggggaacatctccaaggaggaagaagacgtcatcatcaagctccacgccacccttgggaacaggtggtccctgatcgccagccatctgcccggccgaacagacaacgagatcaagaactactggaactcgcacctcagccggcagatccacacataccgccggacctacaccgccggcccggacaccaccataaccatcgacatcagcaagctgcacagcgccgagaagcgccgcggaggccggaccccaggacggtcgccgaagagagccaccaccagcagcggcggcggcggcggcggcagtaacaaggccaagagcaaggagctgccggaccctgatagtaagaagcctgagccggagtccggcgaggcgaaagtcgcctccggcccggttgccgccgcggcctcggcggcgtcgagcccgcggcacagcgacggggcgcggagcgccgtggtggacccggaccagaaccagcccgacagcagcagcggcgccggcggcggcagcacgccggaggggccctgcagcgaggacacgaccgggccgctggcggcgctggacccgatggagtttgggggcctctgggaggccgagagcgagatggagctgctgctgtcgagcggcggtgtcgaggctgggcccgatccgcttacggggtttgttgacgcggtgggtgaggcgggccaggtggacgacctccttgacatggactgggacggcttcgcggcccatatctggggagatcatcctaccgcccaggtccagcagcagaacgacgacgaccagagcacgctgctccagcccgatgggccgcaggccgctgcgggctgcaacgagcaccaggaggacgagctggaatcgttcgcgacctggctcctgtcggactcgttc

SEQ ID NO: 783 - protein, 364 aa, Setaria italica
  Si039538m polypeptide
MGRAPCCEKVGLKRGRWTAEEDEILANYIAKHGEGSWRSLPKNAGLLRCGKSCRLRWINYLRADVKRGNISKEEEDVIIKLHATLGNRWSLIASHLPGRTDNEIKNYWNSHLSRQIHTYRRTYTAGPDTTITIDISKLHSAEKRRGGRTPGRSPKRATTSSGGGGGGSNKAKSKELPDPDSKKPEPESGEAKVASGPVAAAASAASSPRHSDGARSAVVDPDQNQPDSSSGAGGGSTPEGPCSEDTTGPLAALDPMEFGGLWEAESEMELLLSSGGVEAGPDPLTGFVDAVGEAGQVDDLLDMDWDGFAAHIWGDHPTAQVQQQNDDDQSTLLQPDGPQAAAGCNEHQEDELESFATWLLSDSF

SEQ ID NO: 784 - protein, 50 aa, Arabidopsis thaliana
  AT5G49330.1 first SANT domain
RGRWTAEEDEILTKYIQTNGEGSWRSLPKKAGLLRCGKSCRLRWINYLRR

SEQ ID NO: 785 - protein, 48 aa, Arabidopsis thaliana
  AT5G49330.1 second SANT domain
RGNITSDEEEIIVKLHSLLGNRWSLIATHLPGRTDNEIKNYWNSHLSR

SEQ ID NO: 786 - protein, 50 aa, Arabidopsis thaliana
  AT2G47460.1 first SANT domain
RGRWTAEEDQILSNYIQSNGEGSWRSLPKNAGLKRCGKSCRLRWINYLRS

SEQ ID NO: 787 - protein, 48 aa, Arabidopsis thaliana
  AT2G47460.1 second SANT domain
RGNITPEEEELVVKLHSTLGNRWSLIAGHLPGRTDNEIKNYWNSHLSR

SEQ ID NO: 788 - protein, 50 aa, Arabidopsis thaliana
  AT3G62610.1 first SANT domain
KGRWTAEEDRTLSDYIQSNGEGSWRSLPKNAGLKRCGKSCRLRWINYLRS

SEQ ID NO: 789 - protein, 48 aa, Arabidopsis thaliana
  AT3G62610.1 second SANT domain
RGNITPEEEDVIVKLHSTLGTRWSTIASNLPGRTDNEIKNYWNSHLSR

SEQ ID NO: 790 - protein, 50 aa, Glycine max
  Glyma02g01740.1 first SANT domain
KGRWTAEEDEILAKYIQANGEGSWRSLPKNAGLLRCGKSCRLRWINYLRA

SEQ ID NO: 791 - protein, 48 aa, Glycine max
  Glyma02g01740.1 second SANT domain
RGNISAEEENTIVKLHASFGNRWSLIANHLPGRTDNEIKNYWNSHLSR

SEQ ID NO: 792 - protein, 50 aa, Glycine max
  Glyma03g37640.1 first SANT domain
KGRWTEEEDDILTKYIQANGEGSWRSLPTNSGLLRCGKSCRLRWINYLRA

SEQ ID NO: 793 - protein, 48 aa, Glycine max
  Glyma03g37640.1
RGNISFEEESIILKLHASFGNRWSLIASHLPGRTDNEIKNYWNSHLSR

SEQ ID NO: 794 - protein, 50 aa, Glycine max
  Glyma19g40250.1 first SANT domain
KGRWTTEEDEILTKYIMANGEGSWRSLPKNAGLLRCGKSCRLRWINYLRA

SEQ ID NO: 795 - protein, 48 aa, Glycine max
  Glyma19g40250.1 second SANT domain
RGNFSVEEESTILKLHASFGSSWSLIASHLPGRTDNEIKNYWNSHLSR

SEQ ID NO: 796 - protein, 50 aa, Populus trichocarpa
  POPTR_0002s19920.1 first SANT domain
KGRWTAEEDEKLAKYIQANGEGSWRSMPKNAGLLRCGKSCRLRWINYLRA

SEQ ID NO: 797 - protein, 48 aa, Populus trichocarpa
  POPTR_0002s19920.1 second SANT domain
RGNISTEEEEIIVQLHASLGNRWSLIASYLPGRTDNEIKNYWNSHLSR

SEQ ID NO: 798 - protein, 50 aa, Populus trichocarpa
  POPTR_0014s11780.1 first SANT domain
KGRWTAEEDEKLTKYIQANGEGSWRSLPKNAGLLRCGKSCRLRWINYLAA

SEQ ID NO: 799 - protein, 48 aa, Populus trichocarpa
  POPTR_0014s11780.1 second SANT domain
RGNISAEEEEIIINLHASLGNRWSLIASHLPGRTDNEIKNYWNSHLSR

SEQ ID NO: 800 - protein, 50 aa, Populus trichocarpa
  POPTR_0010s15090.1 first SANT domain
KGRWTAEEDEVLTKYILANGEGSWKSLPKNAGLLRCGKSCRLRWINYLRA

SEQ ID NO: 801 - protein, 48 aa, Populus trichocarpa
  POPTR_0010s15090.1 second SANT domain
RGNITKEEEETIVKLHTALGNRWSFIAAQLPGRTDNEIKNYWNSHLSR

SEQ ID NO: 802 - protein, 50 aa, Solanum lycopersicum
  Solyc01g079620.2.1 first SANT domain
RGRWTAEEDQILTNYIISNGEGSWRSLPKNAGLLRCGKSCRLRWINYLRS

SEQ ID NO: 803 - protein, 48 aa, Solanum lycopersicum
  Solyc01g079620.2.1 second SANT domain
RGNITSQEEDIIIKLHATLGNRWSLIAEHLSGRTDNEIKNYWNSHLSR

SEQ ID NO: 804 - protein, 50 aa, Solanum lycopersicum
  Solyc06g009710.2.1 first SANT domain
RGRWTSEEDEILTNYIQANGEGSWRSLPKNAGLLRCGKSCRLRWINYLKS

SEQ ID NO: 805 - protein, 48 aa, Solanum lycopersicum
  Solyc06g009710.2.1 second SANT domain
RGNITSDEEAIIIKLRATLGNRWSLIAEHLPGRTDNEIKNYWNSHLRR

SEQ ID NO: 806 - protein, 50 aa, Solanum lycopersicum
  Solyc12g049350.1.1 first SANT domain
RGRWTIEEDERLTNYIQANGEGSWRTLPKNAGLLRCGKSCRLRWINYLKS

SEQ ID NO: 807 - protein, 48 aa, Solanum lycopersicum
  Solyc12g049350.1.1 second SANT domain
RGNITSEEEAIIIKLRATLGNRWSLIAEYLPHRTDNEIKNYWNSRLCR

SEQ ID NO: 808 - protein, 50 aa, Glycine max
  Glyma07g37140.1 first SANT domain
KGRWTAEEDKILTDYIQENGEGSWSSLPKNAGLLRCGKSCRLRWINYLRS

SEQ ID NO: 809 - protein, 48 aa, Glycine max
  Glyma07g37140.1 second SANT domain
RGNITPQEEEIIVKLHAVLGNRWSVIAGHLPGRTDNEIKNYWNSHLRR

SEQ ID NO: 810 - protein, 50 aa, Glycine max
  Glyma17g03480.1 first SANT domain
KGRWTAEEDKILTDYIQENGEGSWRSLPKNAGLLRCGKSCRLRWINYLRS

SEQ ID NO: 811 - protein, 48 aa, Glycine max; identical to SEQ ID NO: 809
  Glyma17g03480.1 second SANT domain

SEQ ID NO: 812 - protein, 50 aa, Glycine max
  Glyma09g04370.1 first SANT domain
KGRWTAEEDKILTDYIQENGEGSWKILPKNAGLLRCGKSCRLRWINYLRA

SEQ ID NO: 813 - protein, 48 aa, Glycine max
  Glyma09g04370.1 second SANT domain
RGNITPEEEEIIVKLHAVLGNRWSVIAGHLPGRTDNEIKNYWNSHLRR

SEQ ID NO: 814 - protein, 50 aa, Glycine max
  Glyma15g15400.1 first SANT domain
KGRWTAEEDKILTDYIQENGEGSWKTLPKNAGLLRCGKSCRLRWINYLRA

SEQ ID NO: 815 - protein, 48 aa, Glycine max
  Glyma15g15400.1 second SANT domain
RGNITPEEEEIIVKLHAVLGNRWSVIAGRLPGRTDNEIKNYWNSHLRR

SEQ ID NO: 816 - protein, 50 aa, Oryza sativa
  LOC_Os01g19970.1 first SANT domain
RGRWTKEEDEKLARYIRENGEGAWRSMPKNAGLLRCGKSCRLRWINYLRA

SEQ ID NO: 817 - protein, 48 aa, Oryza sativa
  LOC_Os01g19970.1 second SANT domain
RGNISPQEEDIILNLHATLGNRWSLIAGHLPGRTDNEIKNYWNSHLSR

SEQ ID NO: 818 - protein, 50 aa, Zea mays
  GRMZM2G051256_T01 first SANT domain
KGRWTKEEDEVLARYIKEHGEGSWRSLPKNAGLLRCGKSCRLRWINYLRA

SEQ ID NO: 819 - protein, 48 aa, Zea mays
  GRMZM2G051256_T01 second SANT domain
RGNISEEEEDMIIKLHATLGNRWSLIAGHLPGRTDNEIKNYWNSHLSR

SEQ ID NO: 820 - protein, 50 aa, Zea mays
  GRMZM2G051528_T01 first SANT domain
KGRWTREEDEILARYIEEHGEGSWRSLPKNAGLLRCGKSCRLRWINYLRA

SEQ ID NO: 821 - protein, 48 aa, Zea mays
  GRMZM2G051528_T01 second SANT domain
RGNITEEEEDVIVKLHATLGNRWSLIAGHLPGRTDNEIKNHWNSHLRR

SEQ ID NO: 822 - protein, 50 aa, Setaria italica
  Si002107m first SANT domain
KGRWTKEEDEILGRYIKEHGEGSWRSLPKNAGLLRCGKSCRLRWINYLRA

SEQ ID NO: 823 - protein, 48 aa, Setaria italica
  Si002107m second SANT domain
RGNISEEEEEMIIKLHATLGNRWSLIAGHLPGRTDNEIKNYWNSHLSR

SEQ ID NO: 824 - protein, 50 aa, Oryza sativa
  LOC_Os03g19120.1 first SANT domain
RGRWTTEEDEKLAGYIAKHGEGSWRSLPKNAGLLRCGKSCRLRWINYLRA

SEQ ID NO: 825 - protein, 75 aa, Oryza sativa
  LOC_Os03g19120.1 second SANT domain
RGNISNQEEDVIIKLHATLGNRKSYVVKRMDYVCLGARDYCFQQNTHVRWSLIASHLPGRTDNEIKNYWNSHLSR

SEQ ID NO: 826 - protein, 50 aa, Zea mays
  GRMZM2G022686_T01 first SANT domain
RGRWTKEEDQILANYIAEHGEGSWRSLPKNAGLLRCGKSCRLRWINYLRA

SEQ ID NO: 827 - protein, 48 aa, Zea mays
  GRMZM2G022686_T01 second SANT domain
RGNISKEEEDVIIKLHATLGNRWSLIASHLPGRTDNEIKNYWNSHLSR

SEQ ID NO: 828 - protein, 51 aa, Zea mays
  GRMZM2G057027_T02 first SANT domain
KRGRWTAEEDQLLANYIAEHGEGSWRSLPKNAGLLRCGKSCRLRWINYLRA

SEQ ID NO: 829 - protein, 48 aa, Zea mays
  GRMZM2G057027_T02 second SANT domain
RGNISKEEEDIIIKLHATLGNRWSLIASHLPGRTDNEIKNYWNSHLSR

SEQ ID NO: 830 - protein, 50 aa, Zea mays
  GRMZM2G084799_T01 first SANT domain
RGRWTAEEDQLLANYIAEHGEGSWRSLPKNAGLLRCGKSCRLRWINYLRA

SEQ ID NO: 831 - protein, 48 aa, Zea mays; identical to SEQ ID NO: 829
  GRMZM2G084799_T01 second SANT domain

SEQ ID NO: 832 - protein, 50 aa, Setaria italica
  Si039538m first SANT domain
RGRWTAEEDEILANYIAKHGEGSWRSLPKNAGLLRCGKSCRLRWINYLRA

SEQ ID NO: 833 - protein, 48 aa, Setaria italica; identical to SEQ ID NO: 827
  Si039538m second SANT domain

SEQ ID NO: 834 - protein, 141 aa, Arabidopsis thaliana
  MYB111 clade consensus sequence
  misc_feature (2)..(2): Xaa can be any naturally occurring amino acid
  misc_feature (4)..(4): Xaa can be Ser, Ala, or Thr
  misc_feature (8)..(8): Xaa can be Glu or Gly
  misc_feature (10)..(10): Xaa can be Ile, Val, Leu, or Met
  misc_feature (12)..(12): Xaa can be Ile, Val, Leu, or Met
  misc_feature (13)..(14): Xaa can be K or R
  misc_feature (19)..(19): Xaa can be any naturally occurring amino acid
  misc_feature (23)..(24): Xaa can be any naturally occurring amino acid
  misc_feature (26)..(27): Xaa can be any naturally occurring amino acid
  misc_feature (28)..(28): Xaa can be Tyr or Phe
  misc_feature (29)..(29): Xaa can be Ile, Val, Leu, or Met
  misc_feature (30)..(31): Xaa can be any naturally occurring amino acid
  misc_feature (32)..(32): Xaa can be Asn or His
  misc_feature (34)..(34): Xaa can be Glu or Gln
  misc_feature (38)..(39): Xaa can be any naturally occurring amino acid
  misc_feature (40)..(40): Xaa can be Ile, Val, Leu, or Met
  misc_feature (42)..(43): Xaa can be any naturally occurring amino acid
  misc_feature (44)..(44): Xaa can be Ser, Ala, or Thr
  misc_feature (47)..(47): Xaa can be any naturally occurring amino acid
  misc_feature (58)..(58): Xaa can be Ile, Val, Leu, or Met
  misc_feature (62)..(64): Xaa can be any naturally occurring amino acid
  misc_feature (65)..(65): Xaa can be Ile, Val, Leu, or Met
  misc_feature (70)..(70): Xaa can be any naturally occurring amino acid
  misc_feature (71)..(71): Xaa can be Ser, Ala, or Thr
  misc_feature (72)..(72): Xaa can be any naturally occurring amino acid
  misc_feature (73)..(73): Xaa can be Glu, Asp, or Gln
  misc_feature (76)..(77): Xaa can be any naturally occurring amino acid
  misc_feature (78)..(79): Xaa can be Ile, Val, Leu, or Met
  misc_feature (80)..(80): Xaa can be any naturally occurring amino acid
  misc_feature (82)..(82): Xaa can be any naturally occurring amino acid
  misc_feature (83)..(83): Xaa can be Ser, Ala, or Thr
  misc_feature (84)..(84): Xaa can be any naturally occurring amino acid
  misc_feature (85)..(85): Xaa can be Leu or Phe
  misc_feature (87)..(87): Xaa can be Arg or absent
  misc_feature (88)..(88): Xaa can be Lys or absent
  misc_feature (89)..(89): Xaa can be Ser or absent
  misc_feature (90)..(90): Xaa can be Tyr or absent
  misc_feature (91)..(92): Xaa can be Val or absent
  misc_feature (93)..(93): Xaa can be Lys or absent
  misc_feature (94)..(94): Xaa can be Arg or absent
  misc_feature (95)..(95): Xaa can be Met or absent
  misc_feature (96)..(96): Xaa can be Asp or absent
  misc_feature (97)..(97): Xaa can be Tyr or absent
  misc_feature (98)..(98): Xaa can be Val or absent
  misc_feature (99)..(99): Xaa can be Cys or absent
  misc_feature (100)..(100): Xaa can be Leu or absent
  misc_feature (101)..(101): Xaa can be Gly or absent
  misc_feature (102)..(102): Xaa can be Ala or absent
  misc_feature (103)..(103): Xaa can be Arg or absent
  misc_feature (104)..(104): Xaa can be Asp or absent
  misc_feature (105)..(105): Xaa can be Tyr or absent
  misc_feature (106)..(106): Xaa can be Cys or absent
  misc_feature (107)..(107): Xaa can be Phe or absent
  misc_feature (108)..(109): Xaa can be Gln or absent
  misc_feature (110)..(110): Xaa can be Asn or absent
  misc_feature (111)..(111): Xaa can be Thr or absent
  misc_feature (112)..(112): Xaa can be His or absent
  misc_feature (113)..(113): Xaa can be Val or absent
  misc_feature (114)..(114): Xaa can be any naturally occurring amino acid
  misc_feature (117)..(117): Xaa can be any naturally occurring amino acid
  misc_feature (120)..(121): Xaa can be any naturally occurring amino acid
  misc_feature (122)..(122): Xaa can be Ile, Val, Leu, or Met
  misc_feature (123)..(124): Xaa can be any naturally occurring amino acid
  misc_feature (130)..(130): Xaa can be Ile, Val, Leu, or Met
  misc_feature (133)..(133): Xaa can be any naturally occurring amino acid
  misc_feature (136)..(136): Xaa can be Ala, Ser, or Thr
  misc_feature (137)..(137): Xaa can be any naturally occurring amino acid
  misc_feature (139)..(139): Xaa can be any naturally occurring amino acid
  misc_feature (140)..(140): Xaa can be Lys or Arg
  misc_feature (141)..(141): Xaa can be Arg, Lys, or Gln
MXRXPCCXKXGXXXGRWTXEEDXXLXXXXXXXGXGSWXXXPXXXGLXRCGKSCRLRWXNYLXXXXKRGNXXXXEEXXXXXLXXXXGXXXXXXXXXXXXXXXXXXXXXXXXXXXXWSXIAXXXXXRTDNEXKNXWNXXLXXX

SEQ ID NO: 835 - protein, 48 aa, Arabidopsis thaliana
  MYB111 clade first SANT domain consensus sequence
  misc_feature (1)..(1): Xaa can be K or R
  misc_feature (6)..(6): Xaa can be any naturally occurring amino acid
  misc_feature (10)..(11): Xaa can be any naturally occurring amino acid
  misc_feature (13)..(14): Xaa can be any naturally occurring amino acid
  misc_feature (15)..(15): Xaa can be Tyr or Phe
  misc_feature (16)..(16): Xaa can be Ile, Val, Leu, or Met
  misc_feature (17)..(18): Xaa can be any naturally occurring amino acid
  misc_feature (19)..(19): Xaa can be Asn or His
  misc_feature (21)..(21): Xaa can be Glu or Gln
  misc_feature (25)..(26): Xaa can be any naturally occurring amino acid
  misc_feature (27)..(27): Xaa can be Ile, Val, Leu, or Met
  misc_feature (29)..(30): Xaa can be any naturally occurring amino acid
  misc_feature (31)..(31): Xaa can be Ser, Ala, or Thr
  misc_feature (34)..(34): Xaa can be any naturally occurring amino acid
  misc_feature (45)..(45): Xaa can be Ile, Val, Leu, or Met
XGRWTXEEDXXLXXXXXXXGXGSWXXXPXXXGLXRCGKSCRLRWXNYL

SEQ ID NO: 836 - protein, 74 aa, Arabidopsis thaliana
  MYB111 clade second SANT domain consensus sequence
  misc_feature (4)..(4): Xaa can be any naturally occurring amino acid
  misc_feature (5)..(5): Xaa can be Ser, Ala, or Thr
  misc_feature (6)..(6): Xaa can be any naturally occurring amino acid
  misc_feature (7)..(7): Xaa can be Glu, Asp, or Gln
  misc_feature (10)..(11): Xaa can be any naturally occurring amino acid
  misc_feature (12)..(13): Xaa can be Ile, Val, Leu, or Met
  misc_feature (14)..(14): Xaa can be any naturally occurring amino acid
  misc_feature (16)..(16): Xaa can be any naturally occurring amino acid
  misc_feature (17)..(17): Xaa can be Ser, Ala, or Thr
  misc_feature (18)..(18): Xaa can be any naturally occurring amino acid
  misc_feature (19)..(19): Xaa can be Leu or Phe
  misc_feature (21)..(21): Xaa can be Arg or absent
  misc_feature (22)..(22): Xaa can be Lys or absent
  misc_feature (23)..(23): Xaa can be Ser or absent
  misc_feature (24)..(24): Xaa can be Tyr or absent
  misc_feature (25)..(26): Xaa can be Val or absent
  misc_feature (27)..(27): Xaa can be Lys or absent
  misc_feature (28)..(28): Xaa can be Arg or absent
  misc_feature (29)..(29): Xaa can be Met or absent
  misc_feature (30)..(30): Xaa can be Asp or absent
  misc_feature (31)..(31): Xaa can be Tyr or absent
  misc_feature (32)..(32): Xaa can be Val or absent
  misc_feature (33)..(33): Xaa can be Cys or absent
  misc_feature (34)..(34): Xaa can be Leu or absent
  misc_feature (35)..(35): Xaa can be Gly or absent
  misc_feature (36)..(36): Xaa can be Ala or absent
  misc_feature (37)..(37): Xaa can be Arg or absent
  misc_feature (38)..(38): Xaa can be Asp or absent
  misc_feature (39)..(39): Xaa can be Tyr or absent
  misc_feature (40)..(40): Xaa can be Cys or absent
  misc_feature (41)..(41): Xaa can be Phe or absent
  misc_feature (42)..(43): Xaa can be Gln or absent
  misc_feature (44)..(44): Xaa can be Asn or absent
  misc_feature (45)..(45): Xaa can be Thr or absent
  misc_feature (46)..(46): Xaa can be His or absent
  misc_feature (47)..(47): Xaa can be Val or absent
  misc_feature (48)..(48): Xaa can be any naturally occurring amino acid
  misc_feature (51)..(51): Xaa can be any naturally occurring amino acid
  misc_feature (54)..(55): Xaa can be any naturally occurring amino acid
  misc_feature (56)..(56): Xaa can be Ile, Val, Leu, or Met
  misc_feature (57)..(58): Xaa can be any naturally occurring amino acid
  misc_feature (64)..(64): Xaa can be Ile, Val, Leu, or Met
  misc_feature (67)..(67): Xaa can be any naturally occurring amino acid
  misc_feature (70)..(70): Xaa can be Ala, Ser, or Thr
  misc_feature (71)..(71): Xaa can be any naturally occurring amino acid
  misc_feature (73)..(73): Xaa can be any naturally occurring amino acid
  misc_feature (74)..(74): Xaa can be Lys or Arg
RGNXXXXEEXXXXXLXXXXGXXXXXXXXXXXXXXXXXXXXXXXXXXXXWSXIAXXXXXRTDNEXKNXWNXXLXX

SEQ ID NO: 837 - DNA, 747 bp, Arabidopsis thaliana
  AT3G13540.1
atgatgtcatgtggtgggaagaagccagtgtctaagaaaacaacgccgtgttgcacgaagatggggatgaagagaggaccatggacggtggaggaagacgagattcttgtgagcttcattaagaaagaaggtgaaggacggtggcgatcgcttcctaagagagctggtttactcagatgtggaaagagctgtcgtctacggtggatgaactatctccgaccctcggttaaacgtggaggaattacgtcggacgaggaagatctcatcctccgtcttcaccgcctcctcggcaacaggtggtcattgatcgcgggaaggataccgggaaggactgataatgaaattaagaactattggaacactcatcttcgtaagaaacttttaaggcaaggaattgatcctcaaacccacaagcctcttgatgcaaacaacatccataaaccagaagaagaagtttccggtggacaaaagtaccctctagagcctatttctagttctcatactgatgataccactgttaatggcggggatggagatagcaagaacagtatcaatgtctttggtggtgaacacggctacgaagactttggtttctgctacgacgacaagttctcatcgtttcttaattcgctcatcaacgatgttggtgatccttttggtaatattatcccaatatctcaacctttgcagatggatgattgtaaggatgggattgttggagcgtcgtcttctagcttaggacatgac

SEQ ID NO: 838 - protein, 249 aa, Arabidopsis thaliana
  AT3G13540.1 polypeptide
MMSCGGKKPVSKKTTPCCTKMGMKRGPWTVEEDEILVSFIKKEGEGRWRSLPKRAGLLRCGKSCRLRWMNYLRPSVKRGGITSDEEDLILRLHRLLGNRWSLIAGRIPGRTDNEIKNYWNTHLRKKLLRQGIDPQTHKPLDANNIHKPEEEVSGGQKYPLEPISSSHTDDTTVNGGDGDSKNSINVFGGEHGYEDFGFCYDDKFSSFLNSLINDVGDPFGNIIPISQPLQMDDCKDGIVGASSSSLGHD

SEQ ID NO: 839 - DNA, 873 bp, Glycine max
  Glyma13g09980.1
attggtagcaacaactctccatgttgtaacaaggttgggttgaagcgaggtccatggacgccagaagaagacgaggtattagcgaattacatcaagaaagaaggagaaggacggtggagaacgctccccaagcgcgccggacttctccgctgcggcaagagctgccgccttcgctggatgaactacctccgcccctccgttaagcggggccacatcgcccccgacgaggaagatctcatcctccgcctccaccgcctcctcggcaaccggtggtctttgatagctgggaggattcctggaagaacagataatgaaataaaaaactattggaacacccatctaagtaaaaagcttattagccaagggattgatccaagaactcataagcctcttaacccagcatccattaatgttccttcttcttccactacttcttctaaacctcttccaatgatcattaccaacaaccatattaaccctgttcatcacgatctcaccaacatgtttaatcaaggagttcatcaagttcatcatctggtacctgctgctgccaccggtgatgtttctgcaatggctttcatggacaacaacaacgaggattgcaacgatgatatcaacatcaattattactccgacgatgttttttcttccttcctcaactctttgatcaacgatgatgcttttgcggcgcaacagcatcacgtgcaaacggaaatccccacacccagtgagcgtagcatcatgaatccacttccatgtgatgatcgtgttggtggtcatctgggttcaatcgccactgcttctgcagcgcaagccaacacgttgacgatcacatcaccaagagggttcatgatcaccacaatcaatagtatc

SEQ ID NO: 840 - protein, 291 aa, Glycine max
  Glyma13g09980.1 polypeptide
IGSNNSPCCNKVGLKRGPWTPEEDEVLANYIKKEGEGRWRTLPKRAGLLRCGKSCRLRWMNYLRPSVKRGHIAPDEEDLILRLHRLLGNRWSLIAGRIPGRTDNEIKNYWNTHLSKKLISQGIDPRTHKPLNPASINVPSSSTTSSKPLPMIITNNHINPVHHDLTNMFNQGVHQVHHLVPAAATGDVSAMAFMDNNNEDCNDDININYYSDDVFSSFLNSLINDDAFAAQQHHVQTEIPTPSERSIMNPLPCDDRVGGHLGSIATASAAQANTLTITSPRGFMITTINSI

SEQ ID NO: 841 - DNA, 798 bp, Glycine max
  Glyma14g24500.1
cgagggccatggacgccagaggaggacgaggtgttagcgaattacatcaataaagaaggagaaggacggtggagaacgctcccgaagcgcgccggccttctccgctgcggcaagagctgccgcctccgctggatgaactacctccgcccctccgtcaagcgcggccacatcgcccccgacgaggaagatctcatcctccgcctacaccgcctcctgggcaatcggtggtctttgatagctgggaggattcctggaagaacagacaatgaaataaagaactattggaatacccatctaagtaagaagcttattaaccaagggattgatccaagaacccacaagcctcttaacccaccatctattgccgttccttcttcttcaacaacttctactattccaccttctaaacctcctccagtgatcatcaccaacaacaacattaacccttttcatcacgatctcaccaacatgtttaaccaaggagttcatcttaatcatctagtaccagctgctgccaccgatgatgtttctgcaatgggtttcatggacaacaacaacgaggattgcaacaacgatggtatcaacatcaattattactccgacgatgtcttttcttccttcctcaactctttgatcaacgatgatgcttttgaggcgcagcagcagcagcaccaccgtagcattaatccactgccatgtgatgatcgtgtcgatgatcatcatctgggttcaatcaccactgcttctgcatcgcaaggttatgacgatgagcttggggttctgtgggaatcgccactc

SEQ ID NO: 842 - protein, 266 aa, Glycine max
  Glyma14g24500.1 polypeptide
RGPWTPEEDEVLANYINKEGEGRWRTLPKRAGLLRCGKSCRLRWMNYLRPSVKRGHIAPDEEDLILRLHRLLGNRWSLIAGRIPGRTDNEIKNYWNTHLSKKLINQGIDPRTHKPLNPPSIAVPSSSTTSTIPPSKPPPVIITNNNINPFHHDLTNMFNQGVHLNHLVPAAATDDVSAMGFMDNNNEDCNNDGININYYSDDVFSSFLNSLINDDAFEAQQQQHHRSINPLPCDDRVDDHHLGSITTASASQGYDDELGVLWESPL

SEQ ID NO: 843 - DNA, 948 bp, Populus trichocarpa
  POPTR_0001s04240.1
atgagaaagccaacttcagctacaacagcagaatcagcagcaaagaccaccccatgctgcatcaaggtagggttaaagagaggaccgtggacaccagaagaagatgaactccttgttaactatatcaagaaagaaggtgaaggtcggtggcgaactttacccaagaaagccggtctcctccgctgtggcaagagctgccgtctccgctggatgaactacctccgcccttctgttaaacgtggccagatcgccgatgatgaagaagatctcattctccgcctccatcgactcctaggcaataggtggtcattgatagctgggagaattccagggcgtacagataatgaaataaagaattactggaacacgcacctgagtaagaagctgataagccagggaattgatccaagaacccataagcctctcaatcctcaatcttttgatcaatcaaaaccttctttgtcgaaggcgaatctgcaccaagcacgcctaaaagaacctattaagaatattgtttcttctggtttggaagaagctactagtggcagtactcgcataatcaacagagagaatgagtattttcaaaacaacattaatgcccacctcgatgatcagtatcacgccgaccattttattgcaagtcatggctatacaagtttgctgaattatgatggtacttctgggatggatttgaaaggcgatcaaagtcttggtattggagaagctgatcaagatatcaattccggcaccgacgatgtgttttcgttcctgaattcactcataaatgaggaggctttgcaacaacatcaaatccttaatgtgcctaatgtgaattgtgcaccacccagttcagatccttttgtttcaattgctgccacaacatttggactcggaactggctgggaatctactctcatgtcttctgcttttaaccaaaatgaatccaaa

SEQ ID NO: 844 - protein, 316 aa, Populus trichocarpa
  POPTR_0001s04240.1 polypeptide
MRKPTSATTAESAAKTTPCCIKVGLKRGPWTPEEDELLVNYIKKEGEGRWRTLPKKAGLLRCGKSCRLRWMNYLRPSVKRGQIADDEEDLILRLHRLLGNRWSLIAGRIPGRTDNEIKNYWNTHLSKKLISQGIDPRTHKPLNPQSFDQSKPSLSKANLHQARLKEPIKNIVSSGLEEATSGSTRIINRENEYFQNNINAHLDDQYHADHFIASHGYTSLLNYDGTSGMDLKGDQSLGIGEADQDINSGTDDVFSFLNSLINEEALQQHQILNVPNVNCAPPSSDPFVSIAATTFGLGTGWESTLMSSAFNQNESK

SEQ ID NO: 845 - DNA, 975 bp, Populus trichocarpa
  POPTR_0003s21120.1
atgagaaagccaacttcatctacagctacagctgaagcagcggcggcaggaggaggaccagcggcaaaatctactccgtgttgcatcaaggtagggttaaagagaggaccatggacacctgaagaagatgaacttctagctaactatatcaagaaagaaggtgaaggtcggtggcgaactttacccaagaaagctggtcttctccgctgtggcaaaagctgccgtctccgctggatgaactacctccgcccttctgttaaacgtggccagatctcccctgatgaagaagatctcattctccgcctccatcgcctcctaggcaataggtggtcattgatagctgggagaatcccagggcgtacagacaatgagataaagaattactggaacactcacctgagtaagaagttgataagccaaggaattgatccaagaacccacaagcctctcatcaatcctcaatcttttgatcaatccaaaccttcttcgtcgaaagcgaaccacctgcaagaaagcctaaaagagcctattaagattgcttcttctggtttggaagaaactaccagtggcagtgctcacataatcagcaacaaagagaatgggtattttcaaaacaacagtaatgcacacctgggtgatcagtatcacacggaccattttattgcaagtcgtggctacacaagtttgctgaattatgatggttcttttgggacggatttgagaggtaatcaaaggcttggtaatggagaagctgaagatatcaattctggcacagaagatgtgttttccttcctcaattcactcataaatgaggaggctttccaacaacaccagatctttaatgagcctaatgtgaatagtgcaccagccagtacagatcctttgtttccaattgctgccgcaacatcatttggacttagtactggctgggaatctactctcatgccttctgctcttgatcaaaatgattcgaaa

SEQ ID NO: 846 - protein, 325 aa, Populus trichocarpa
  POPTR_0003s21120.1 polypeptide
MRKPTSSTATAEAAAAGGGPAAKSTPCCIKVGLKRGPWTPEEDELLANYIKKEGEGRWRTLPKKAGLLRCGKSCRLRWMNYLRPSVKRGQISPDEEDLILRLHRLLGNRWSLIAGRIPGRTDNEIKNYWNTHLSKKLISQGIDPRTHKPLINPQSFDQSKPSSSKANHLQESLKEPIKIASSGLEETTSGSAHIISNKENGYFQNNSNAHLGDQYHTDHFIASRGYTSLLNYDGSFGTDLRGNQRLGNGEAEDINSGTEDVFSFLNSLINEEAFQQHQIFNEPNVNSAPASTDPLFPIAAATSFGLSTGWESTLMPSALDQNDSK

SEQ ID NO: 847 - DNA, 924 bp, Solanum lycopersicum
  Solyc01g005660.1.1
atgagaacaccatcatcatcgtcatcatcatcattatcatcgagaactaaaattgtaacaccatgttgtacaaaaatagggttaaaaaggggtccatggacaccagaagaagacgaattactgatgaattacgtcagtaaagaaggggaagggcggtggcgtacactcccaaagaaggcgggactcttccgttgtgggaagagttgtcgccttcgttggatgaactacctccgcccttccgttaaacgcggacatattttgccggaggaggaagatctcatcctccggctccatcgcctcctcgggaacaggtggtcattgatagcagggagaattcccggaagaacagataacgagataaagaattattggaatacccaccttagcaagaaattaatcaaccaaggaatagatccaagaacacacaaaccattaatattaaacaaccctaattcctctaatagtgatgataatcacattattacaaacaaagctaattcttcttctccttcttcatcctcaaaactagcaaataattataatctcaacacaattaatattccaaaccccatttacactcctaatttccaaatgaaagaacccttaagaagtagcatcaacaataataactgtcctggagaaactacgagtcctgatgatgattatcagtatcagagcagtaatgtgatgcttgccaattatcgcgatgatgatatgaatattgtggttcatgatgagggagatgatgaaatgaattgttgcgcggacgatgtcttctcctccttcttgaattctttgatcaatgaagacatgttcatgaattgccaaaatcaacaaatcaatggtacattgcaagattttgatcattttatggcttcatcttcaccttcatatgatcaaaataatctcaagacaatggatgaa

SEQ ID NO: 848 - protein, 308 aa, Solanum lycopersicum
  Solyc01g005660.1.1 polypeptide
MRTPSSSSSSSLSSRTKIVTPCCTKIGLKRGPWTPEEDELLMNYVSKEGEGRWRTLPKKAGLFRCGKSCRLRWMNYLRPSVKRGHILPEEEDLILRLHRLLGNRWSLIAGRIPGRTDNEIKNYWNTHLSKKLINQGIDPRTHKPLILNNPNSSNSDDNHIITNKANSSSPSSSSKLANNYNLNTINIPNPIYTPNFQMKEPLRSSINNNNCPGETTSPDDDYQYQSSNVMLANYRDDDMNIVVHDEGDDEMNCCADDVFSSFLNSLINEDMFMNCQNQQINGTLQDFDHFMASSSPSYDQNNLKTMDE

SEQ ID NO: 849 - DNA, 912 bp, Populus trichocarpa
  POPTR_0013s05300.1
atgaggaatctatcctcaaggaactcaacaaggagcaggagtacacccacaccatgttgtagcaaggtaggtataaagagaggaccgtggacacctgaagaagatgagctcttggctaactacatcaagaacgatggtgaagggcgatggcgtacactgccaaagcaggcagggcttcttaggtgtggtaagagctgccgcctccgatggatgaactatctcaggccttctgttaagagaggacgtattgccccagatgaagaagatctcattcttaggcttcataggttgcttggtaacaggtggtctttgatagccgggaggataccaggacgcacagataatgagatcaagaattactggaacacccatctcagcaagaagctcattagtcaaggaattgatccaaggacccacaagcctttataccctaaccctaattcatcagagattgccaatattgctcccacccaaaactccaaccctaattcttttccactagaagagaatgccagggtcgatcgagctacagccactagagtaattgagaacttaacaataactaacttggatcagtttccaaatcaggtcattgatgatggtgccaaaaactggcctagttgtgatggttttaataaggggttacaaagtcatcatgaacaaaacaaagaggaagattacattggaaatgaaaatgaggacacgttctctttgtttctggattctctgatcaatgaaaatgtatttgcgtatcaacaacaacaacagtgtaatattattggaccatcaggtcaacctgtgatttcttcttcacaggctttccatcatggcagtatttgggaagctgaagtcacatcttcaatggcagctttcggtgagaaagatggtgcgttaaatagtgatgatctagct

SEQ ID NO: 850 - protein, 304 aa, Populus trichocarpa
  POPTR_0013s05300.1 polypeptide
MRNLSSRNSTRSRSTPTPCCSKVGIKRGPWTPEEDELLANYIKNDGEGRWRTLPKQAGLLRCGKSCRLRWMNYLRPSVKRGRIAPDEEDLILRLHRLLGNRWSLIAGRIPGRTDNEIKNYWNTHLSKKLISQGIDPRTHKPLYPNPNSSEIANIAPTQNSNPNSFPLEENARVDRATATRVIENLTITNLDQFPNQVIDDGAKNWPSCDGFNKGLQSHHEQNKEEDYIGNENEDTFSLFLDSLINENVFAYQQQQQCNIIGPSGQPVISSSQAFHHGSIWEAEVTSSMAAFGEKDGALNSDDLA

SEQ ID NO: 851 - DNA, 924 bp, Populus trichocarpa
  POPTR_0013s05310.1
atgaggaatctatcctcaaggaactcaacaaggagcaggaatacacccacaccatgttgtagcaaagtgggtataaagagggggccgtggacacctgaagaagatgagatcttggcaaactacatcaagaaggatggtgaagggcggtggcgtacactgccaaagcgggcggggcttcttaggtgtggtaagagctgccgcctccgatggatgaactatctcaggccttctgttaagagaggacgtattgccccagatgaagaagatctcattcttaggcttcataggttgcttggtaacagatggtctttgatagctgggaggataccaggacgcaccgataatgagatcaagaattactggaacacccatctcagcaagaagctcatcagtcaaggaatcgatccaaggacgcacaagcctttataccctaaccccaattcatcagaaattgccaatatcgctcccatccaaaattgtatccttaattcttttccactagaagcgaatggcggggtctatcgagctacagccactagagaaaatgagaactttacaatgactaacttggatcagtttccaaatcaggtcattgatgatggtgccaaaaactggcctagttgtgatggttttaataaggggttacaaagtcatcatgaacaaaacaaagaggaagattacattggaaatgaaaatgaggacacgttctctttgtttctggattctctgatcaatgaaaatgtatttgcgtatcaacaacaacaacaacagttacagcagcctaagattattggaccatctggtgaacctatgatttcttcttcacaggctattcatcatagcagcatttcggaagctgaagtcgcatattccatggcagctttcggtgagaaagatggtgtgttaaatagtcatgatctagct

SEQ ID NO: 852 - protein, 308 aa, Populus trichocarpa
  POPTR_0013s05310.1 polypeptide
MRNLSSRNSTRSRNTPTPCCSKVGIKRGPWTPEEDEILANYIKKDGEGRWRTLPKRAGLLRCGKSCRLRWMNYLRPSVKRGRIAPDEEDLILRLHRLLGNRWSLIAGRIPGRTDNEIKNYWNTHLSKKLISQGIDPRTHKPLYPNPNSSEIANIAPIQNCILNSFPLEANGGVYRATATRENENFTMTNLDQFPNQVIDDGAKNWPSCDGFNKGLQSHHEQNKEEDYIGNENEDTFSLFLDSLINENVFAYQQQQQQLQQPKIIGPSGEPMISSSQAIHHSSISEAEVAYSMAAFGEKDGVLNSHDLA

SEQ ID NO: 853 - DNA, 879 bp, Populus trichocarpa
  POPTR_0019s05190.1
atgaggaatctatgctcaacaacttcaacaaggagcaggagtgtacctacaccatgttgtagcaaggtgggcataaagaaggggccatggacaccagaagaggatgagctcttggcaaactacatcaggaaagaaggtcaagggcgatggcgcacgctcccaaagcgggcaggacttcttaggtgtggtaagagctgccgcctccgctggatgaactatctcaggccttctgttaagagagggcgtattgccccagatgaggaagatctcattcttaggcttcacaggttgcttggtaacaggtggtctatgatagctgggaggataccagggcgcacagataatgagattaagaattactggaatacctgtctcagcaagaagctcattagccaaggaatagaccctaggactcacaagcctttaaaacctaaccccgattcctcagaaattgcaaatgttccagtccagaattctaaccctaaatcttctccactggatgagaattggagggtctatcgaactgtagccactagggttgctgctggtgctaccgaaaactggccaaatcgtgatggttttactatgggatcattacaaagtggccatggacgaaaaaatgaagatgatttcattgaagatattggaaatgaggacactttctcctcatttctggattccttgctcaatgaaaacgtgttcgtgtatcaacaacgacaacagttacagcatcaaaatatgtttgggccttcttctaagcttgcggtttcttcttcacaaattctcagtcacgcaaacatttgggaagctgaagtctcgcctccaatggcagccttatgtgacaaaggcgtgggcggggcttcaaatagtcttccagtt

SEQ ID NO: 854 - protein, 293 aa, Populus trichocarpa
  POPTR_0019s05190.1 polypeptide
MRNLCSTTSTRSRSVPTPCCSKVGIKKGPWTPEEDELLANYIRKEGQGRWRTLPKRAGLLRCGKSCRLRWMNYLRPSVKRGRIAPDEEDLILRLHRLLGNRWSMIAGRIPGRTDNEIKNYWNTCLSKKLISQGIDPRTHKPLKPNPDSSEIANVPVQNSNPKSSPLDENWRVYRTVATRVAAGATENWPNRDGFTMGSLQSGHGRKNEDDFIEDIGNEDTFSSFLDSLLNENVFVYQQRQQLQHQNMFGPSSKLAVSSSQILSHANIWEAEVSPPMAALCDKGVGGASNSLPV

SEQ ID NO: 855 - DNA, 927 bp, Populus trichocarpa
  POPTR_0019s05200.1
atgaggaatctatgctcaacaacttcaacaaggaacaggagtgtacctacaccatgttgtagcaaggtgggcataaagaaggggccatggacaccagaagaggatgagctcttggcaaactacatcaggaaagaaggtcaagggcgatggcgcacgctcccaaagcgggcaggacttctcaggtgtggtaagagctgccgcctccgctggatgaactatctcaggccttctgttaagagagggcgtattgccccagatgaggaagatctcattcttaggcttcacaggttgcttggtaacaggtggtctatgatagctgggaggataccagggcgcacagataatgagattaagaattactggaatacctgtctcagcaagaagctcattagccaaggaatagaccctaggacccacaagcctttaaaacctaaccccgattcctcagaaattgcaaatgttccagtccagaattctaaccctaaatcttctccagtggatgagaatgggagggtctatcgaactgtagccactagagtaagtgaaaactttacagtgactaacctggatcagtctcctaaccaggttgctgctgatgctacagaaaactggccaaatcgtgatggttttaatatgggatcattacaaagtggttatggacgaaaaaatgaagatgatttcattgaagatattggaaatgaggacactttctcctcatttctggattccttgctcaatgaaaatgtgttagtgtatcaacaacgacaacagttacagcatcaaaatatgtttgggccttcttctaagcttgcggtttcttcttcacaaattctcagtcacgcaaacatttgggaagctgaagtctcgcctccaatggcagccttaggtgacaaaggcgtgggcggggcttcaaatagtcttccagtt

SEQ ID NO: 856 - protein, 309 aa, Populus trichocarpa
  POPTR_0019s05200.1 polypeptide
MRNLCSTTSTRNRSVPTPCCSKVGIKKGPWTPEEDELLANYIRKEGQGRWRTLPKRAGLLRCGKSCRLRWMNYLRPSVKRGRIAPDEEDLILRLHRLLGNRWSMIAGRIPGRTDNEIKNYWNTCLSKKLISQGIDPRTHKPLKPNPDSSEIANVPVQNSNPKSSPVDENGRVYRTVATRVSENFTVTNLDQSPNQVAADATENWPNRDGFNMGSLQSGYGRKNEDDFIEDIGNEDTFSSFLDSLLNENVLVYQQRQQLQHQNMFGPSSKLAVSSSQILSHANIWEAEVSPPMAALGDKGVGGASNSLPV

SEQ ID NO: 857 - DNA, 927 bp, Populus trichocarpa
  POPTR_0019s05210.1
atgaggaatctatgctcaacaacttcaacaaggagcaggagtgtacctacaccatgttgtagcaaggtgggcataaagaaggggccatggacaccagaagaggatgagctcttggcaaactacatcaggaaagaaggtgaagggcgatggcgcacgctcccaaagcgggcaggacttctcaggtgtggtaagagctgccgcctccgctggatgaactatctcaggccttctgttaagagagggcgtattgccccagatgaggaagatctcattcttaggcttcacaggttgcttggtaacaggtggtctatgatagctgggaggataccagggcgcacagataatgagattaagaattactggaatacctgtctcagcaagaagctcattagccaaggaatagaccctaggactcacaagcctttaaaacctaaccccgattcctcagaaattgcaaatgttccagtccagaattctaaccctaaatcttctccagtggatgagaatgggagggtctatcgaactgtagccactagagtaagtgaaaactttacagtgactaacctggatcagtctcctaaccaggttgctgctgatgctacagaaaactggccaaatcgtgatggttttaatatgggatcattacaaagtggttatggacgaaaaaatgaagatgatttcattgaagatattggaaatgaggacactttctcctcatttctggattccttgctcaatgaaaatgtgttcgtgtatcaacaacgacaacagttacagcagcaaaatatgtttggaccttcttctaagcttgcggtttcttcttcacaaattctcagtcacgaaaacatttgggaagctgaagtctcgcctccaatggcagccttaggtgacaaaggcgtgggtggggcttcaaatcgtcttccagtt

SEQ ID NO: 858 - protein, 309 aa, Populus trichocarpa
  POPTR_0019s05210.1 polypeptide
MRNLCSTTSTRSRSVPTPCCSKVGIKKGPWTPEEDELLANYIRKEGEGRWRTLPKRAGLLRCGKSCRLRWMNYLRPSVKRGRIAPDEEDLILRLHRLLGNRWSMIAGRIPGRTDNEIKNYWNTCLSKKLISQGIDPRTHKPLKPNPDSSEIANVPVQNSNPKSSPVDENGRVYRTVATRVSENFTVTNLDQSPNQVAADATENWPNRDGFNMGSLQSGYGRKNEDDFIEDIGNEDTFSSFLDSLLNENVFVYQQRQQLQQQNMFGPSSKLAVSSSQILSHENIWEAEVSPPMAALGDKGVGGASNRLPV

SEQ ID NO: 859 - DNA, 825 bp, Oryza sativa
  LOC_Os01g50110.1
atgaagcggaagcggccggcggcgctgcgcggcggggaggaggcggcggcggcggcgctgaagcgtgggccgtggacgcccgaggaggacgaggtgctggcgcggttcgtggcgcgggaggggtgcgaccggtggcgcacgctgccgcggcgcgcgggcctgctgcgctgcggcaagagctgccgcctccggtggatgaactacctccgccccgacatcaagcgctgccccatcgccgacgacgaggaggacctcatcctccgcctccaccgcctcctcggcaaccggtggtcgctgatcgccgggaggttgccggggcgcacggacaacgagatcaagaactactggaactcgcatctcagcaagaagctcatcgcgcagggcatcgacccgcggacgcacaagccgctgacggccgccgccgatcactccaacgccgccgctgccgtcgccgccacttcttacaagaaggcggtgccggccaagccgccgaggacggcatcctcgccggccgctggcattgagtgcagcgacgatcgtgcccgaccggccgacggtggcggtgacttcgcagcgatggtgagcgccgccgatgccgagggattcgaaggaggatttggcgatcagttctgtgccgaggatgcagttcatggtggcttcgacatgggttccgcttccgccatggtgggtgacgacgacttctcctcgtttcttgattctctgatcaacgacgagcagttaggcgatctcttcgtcgtcgagggcaacgatcacgagcatggcaatggtgagattggtcatggagacgtcatggaatccaaacag

SEQ ID NO: 860 - protein, 275 aa, Oryza sativa
  LOC_Os01g50110.1 polypeptide
MKRKRPAALRGGEEAAAAALKRGPWTPEEDEVLARFVAREGCDRWRTLPRRAGLLRCGKSCRLRWMNYLRPDIKRCPIADDEEDLILRLHRLLGNRWSLIAGRLPGRTDNEIKNYWNSHLSKKLIAQGIDPRTHKPLTAAADHSNAAAAVAATSYKKAVPAKPPRTASSPAAGIECSDDRARPADGGGDFAAMVSAADAEGFEGGFGDQFCAEDAVHGGFDMGSASAMVGDDDFSSFLDSLINDEQLGDLFVVEGNDHEHGNGEIGHGDVMESKQ

SEQ ID NO: 861 - DNA, 804 bp, Zea mays
  GRMZM2G395672_T01
atgcggaagccggcggtgcagcagcgtggcgcgggggcgataaggacgctcaagcggggtgcgtggacgccggaggaggacgagctgctggcgcgggccgtggcgaaggacggggaggggcggtggcgcacgctgccgcggcgggcggggctgcttcgctgcggcaagagctgcaggctccgctggatgaactacctcaggccggacatcaagcgcgggcctatcgccgccgacgaggaggacctcatcctccgcctccaccgcctgctcggaaaccggtggtcgctgatcgctgggcgtctgcctggccgcacggacaacgaggtcaagaactactggaactcgcacctcagcaagaagctcgtcgcgcggggcatcgacccgcgcacgcacacgcctctgcccgcagcagctgcgagcctgcactcgcactcccaccgcgccgacgacgactcaccagcaggagccgccggttcgtctgccgacaagacgccgccgccactggtggaagtcgagccatcggttgcgccgccgccagcgcagccgaactcatctttcggcgacggaagcagcggcgacttcgcggggggcatgatgggtctaggctccgagggcttcgatggagtcggtgatccgttctgtgcaccagctcctggcggcttccacttgggctgccccgtcgtggacgacgccaccttctcctcgttcctcgactcgctgatgaacgaggagcgcatgcgcatcgccgattacattggagatcacagggatgctgatggtgggaacgaccagggtggagcttat

SEQ ID NO: 862 - protein, 268 aa, Zea mays
  GRMZM2G395672_T01 polypeptide
MRKPAVQQRGAGAIRTLKRGAWTPEEDELLARAVAKDGEGRWRTLPRRAGLLRCGKSCRLRWMNYLRPDIKRGPIAADEEDLILRLHRLLGNRWSLIAGRLPGRTDNEVKNYWNSHLSKKLVARGIDPRTHTPLPAAAASLHSHSHRADDDSPAGAAGSSADKTPPPLVEVEPSVAPPPAQPNSSFGDGSSGDFAGGMMGLGSEGFDGVGDPFCAPAPGGFHLGCPVVDDATFSSFLDSLMNEERMRIADYIGDHRDADGGNDQGGAY

SEQ ID NO: 863 - DNA, 1758 bp, Arabidopsis thaliana
  AtNPR3 (AT5G45110.1 or G839)
atggctactttgactgagccatcatcatctttgagtttcacatcttctcatttctcttatggttctattgggtccaatcacttctcatcaagctcagcttctaatcctgaagttgttagtctaaccaaactcagctccaatcttgagcagcttcttagtaattcagattgtgattacagtgatgcagagatcattgttgatggtgttccagttggtgttcatagatgcattttagctgcaagaagtaagtttttccaagatttgtttaagaaagaaaagaaaatttcgaaaactgagaaaccaaagtatcagttgagagagatgttaccttatggagctgttgctcatgaagctttcttgtatttcttgagttatatatatactgggagattaaagccttttccattggaggtttcgacttgtgttgatccagtttgttctcatgattgttgtcgacctgccattgattttgttgttcaattgatgtatgcttcctctgttctccaagtgcctgagctagtttcatcttttcagcggcggctttgtaactttgtggagaagacccttgttgagaatgttcttcccattcttatggttgctttcaattgtaagttgactcagcttcttgatcagtgtattgagagagtggcgaggtcagatctttacaggttctgtattgaaaaggaagttcctcccgaagtagcagagaagattaaacagcttcgacttatatccccgcaagacgaagaaaccagtcccaagatttcggagaaattgcttgaaagaatcggtaaaattctcaaggccttggattcagatgatgttgagcttgtgaagcttcttttgactgagtcagatatcactctagatcaagccaatggtctgcattattctgttgtgtatagtgatccgaaagttgttgccgagattcttgctctggatatgggtgatgtgaactacaggaattcccggggttacacggttcttcattttgctgcgatgcgtagagagccatcgatcattatatcgcttatcgataaaggcgccaatgcatctgagtttacatctgacggacgtagcgcagttaatatattaagaagactgacaaatccaaaggattatcataccaaaacagctaaagggcgtgaatctagtaaagccaggttatgcatcgatatcttggaaagagaaatcaggaagaaccccatggttctagatacaccaatgtgttccatttctatgcctgaagatctccagatgagactgttgtacctagaaaagagagtggggcttgctcagttgttctttccaacggaagctaaagttgctatggacattggtaacgtagaaggtacaagtgagttcacgggtttgtcacctccttcgagtgggttaaccggaaacttgagtcaggttgatttaaacgaaactcctcatatgcaaacccaaagacttcttactcgtatggtggctctaatgaaaacagttgagactggtcgaaggttttttccatatggttcagaggttctagataagtacatggctgagtatatagacgacgacatcctcgacgatttccattttgagaagggatctacacatgaaagaagattgaaaagaatgagatatagagagcttaaggatgatgtccaaaaggcatatagcaaagacaaagagtctaagattgcgcggtcttgtctttctgcttcatcttctccttcttcttcttccataagagatgacctgcacaacacaaca

SEQ ID NO: 864 - protein, 586 aa, Arabidopsis thaliana
  AtNPR3 (AT5G45110.1 or G839) polypeptide
MATLTEPSSSLSFTSSHFSYGSIGSNHFSSSSASNPEVVSLTKLSSNLEQLLSNSDCDYSDAEIIVDGVPVGVHRCILAARSKFFQDLFKKEKKISKTEKPKYQLREMLPYGAVAHEAFLYFLSYIYTGRLKPFPLEVSTCVDPVCSHDCCRPAIDFVVQLMYASSVLQVPELVSSFQRRLCNFVEKTLVENVLPILMVAFNCKLTQLLDQCIERVARSDLYRFCIEKEVPPEVAEKIKQLRLISPQDEETSPKISEKLLERIGKILKALDSDDVELVKLLLTESDITLDQANGLHYSVVYSDPKVVAEILALDMGDVNYRNSRGYTVLHFAAMRREPSIIISLIDKGANASEFTSDGRSAVNILRRLTNPKDYHTKTAKGRESSKARLCIDILEREIRKNPMVLDTPMCSISMPEDLQMRLLYLEKRVGLAQLFFPTEAKVAMDIGNVEGTSEFTGLSPPSSGLTGNLSQVDLNETPHMQTQRLLTRMVALMKTVETGRRFFPYGSEVLDKYMAEYIDDDILDDFHFEKGSTHERRLKRMRYRELKDDVQKAYSKDKESKIARSCLSASSSPSSSSIRDDLHNTT

SEQ ID NO: 865 - DNA, 1863 bp, Zea mays
  GRMZM2G076450_T01
atggagccgtcgtcgtccatcacgttcgcgtcgtcgtcgtcgtacctgtccaacggctcgagcccctgttccgtcgcgctgccgccgccagggccgccccagactcccccgttgcctgccggccaggggtggggtggtggagtcgctgccgcagggagcggaggcagcgtggaggccgtgagcctgaaccggctcagcaaaaacctcgagcggctgctcctcgacccggacctagactgcagcgacgccgacgtcgatgtgcccgacggtgggccgcccgtacccatccaccgctgcatccttgccgcacgcagcgacttcttctacgacctcttcgccgctcgcggccgcgcaggggcagcgcgcggtgatgcggccgccggcgccggagtagccgcggagggggctgccagtggaaggccgcggtacaagatggaggatctcgttcccgccggccgcgtggggcgcgaggccttccaggcgtttctggggtacctgtacaccggcaagctccggccggcaccggtcgacgtggtgtcttgtgctgacccagtgtgccatcacgattcgtgcccgccggccatcaggtccgcggtcgagctcatgtacgcggcgtgtaccttcaagatccccgagctcacctcgctcttccagcgccggcttcttaattttgtagacaagactctagtggaggatgttattcctattctggaagttgcttcccactcagggctgactcaagtgatcgacaaatgtattcaaaggattgctagatcagatctcgacgatatatctttggataaggagctccctccagaagcagttgatgagataaaaaatttgcgcaagaagtcacaaactgctgatggtgatacgttcatttcggaccctgtgcatgagaaaagagtcagaagaatccacagggcacttgactctgatgatgttgagcttgtgaagttgcttcttaatgagtccgacatcacattagatgatgccaacgcattacactatgctgcttcttactgtgatcctaaagttgtctcagagctgttagatttggcaatggctaacttaaatttgaagaatagccgtgggtacacagcactccacttggctgctatgaggagagaaccagctataatcatgtgtctccttaacaaaggggcaaatgtgtcacaactgacagctgatggcaggagcgcaattggtatttgtcggaggttaacaagagcaaaagactacaatacaaagatggagcagggtcaagaatcaaataaagataggctgtgtatagatattctagagagggagatgatgcggaatcctatggcggtggaagatgccgtcacctcgcctttgttggcagatgatcttcacatgaagcttctctacctggaaaacagagttgcatttgctagattgttctttcctgctgaagccaaggtcgccatgcaaatcgcacaagcagacaccacagaagaattcggcggtatagttgcagttgcagcaagcacttctggtaaactgagggaggtggaccttaatgagacgccagtgacacaaaacaaaaggctccgttcaagggtagatgcactgatgaaaacagtggagctgggccgtcggtacttcccgaactgctcgcaggtgctggacaagttcctggaggacgatctgccggaaggtctggaccagttctacctccagaggggcacagccgatgagcagaaggtgaagaggatgcgcttctgcgagctgaaagaggacgtgctgaaggcgtttagcaaggacaaggcggagggcagcgtgttctcgggcctgtcctcgtcgtcgtcgtgctcgccgccccagaagtatgcccagagg

SEQ ID NO: 866 - protein, 621 aa, Zea mays
  GRMZM2G076450_T01 polypeptide
MEPSSSITFASSSSYLSNGSSPCSVALPPPGPPQTPPLPAGQGWGGGVAAAGSGGSVEAVSLNRLSKNLERLLLDPDLDCSDADVDVPDGGPPVPIHRCILAARSDFFYDLFAARGRAGAARGDAAAGAGVAAEGAASGRPRYKMEDLVPAGRVGREAFQAFLGYLYTGKLRPAPVDVVSCADPVCHHDSCPPAIRSAVELMYAACTFKIPELTSLFQRRLLNFVDKTLVEDVIPILEVASHSGLTQVIDKCIQRIARSDLDDISLDKELPPEAVDEIKNLRKKSQTADGDTFISDPVHEKRVRRIHRALDSDDVELVKLLLNESDITLDDANALHYAASYCDPKVVSELLDLAMANLNLKNSRGYTALHLAAMRREPAIIMCLLNKGANVSQLTADGRSAIGICRRLTRAKDYNTKMEQGQESNKDRLCIDILEREMMRNPMAVEDAVTSPLLADDLHMKLLYLENRVAFARLFFPAEAKVAMQIAQADTTEEFGGIVAVAASTSGKLREVDLNETPVTQNKRLRSRVDALMKTVELGRRYFPNCSQVLDKFLEDDLPEGLDQFYLQRGTADEQKVKRMRFCELKEDVLKAFSKDKAEGSVFSGLSSSSSCSPPQKYAQR

SEQ ID NO: 867 - DNA, 1917 bp, Setaria italica
  Si000647m
atggagccgtcgtcgtccatcacgttcgcgtcctcgtcgtcgtacctgtccaacgggtccagcccctgctccgtcgcgctcccgccgccggggccgccccaggctcccccgttgaccgccggcgacgggtggggtagtggtggcgctgctggagggagcagcagcaacgtggaggcggtgagcctgaaccggctcagcaaaaacctcgagcggctcctcatcgacgaggacctcgactgcagcgacgccgacatcgaggtgcccgacggtgggccgcccgtccccgtccaccgctgtatactcgccgtgcggagccccttcttctacgacatcttcgccgcgcgcggccgcggaggcgcagcgcgaggtgatgctgccgccggtgccagaggggcgggagagggggctgccagtggcaggccgcggtacaagatggaggagctcgtccccggcggccgcgtggggcgcgaagccttccaggcgttcctgggctatctgtacaccggcaagctccggccggcaccgctcgatgtggtgtcttgtgctgaccccgtgtgccctcatgactcgtgcccgccggccatcaggttcgccgtcgagctcatgtatgcggcgtggaccttcaagatccccgagctcatttcgctgttccagcggcggcttcttaactttgtagacaagactctagtggaagatgtcattcctattctgcaagttgcttcacactcagagctgactcaagtgctcgacaaatgcattcagaggattgctagatcaaatcttgatgatatatctttggataaggagctttctccagaagttgtcgaggagataaaaaagattcgtaaaaagttgcaaactgctgatgatgacgcctccatttcggaccctgtgcatgagaaaagagtcagaagaatccacagagcactcgactctgatgatgttgagcttgtgaagttgcttcttaatgagtctgagatcacattagatgatgccaatgcattgcactatgcagcttcttactgtgattctaaggttgtctcggagttgttagagttggggctggctaacttgaatttgaagaatagccgtggatacacagcactccacttggctgctatgaggagagaaccagctatcattatgtgcctccttaacaaaggggcaactgtatcacaactgacagctgatggccggagtgcaattggtatttgtcggaggttaacaagagcaaaagactacaatacaaagatggagcagggtcaagagtcaaacaaagataggttgtgtatagatattctagagcgggagatgatgcgaaatcctatgtcagtggaagatgctgtcacctcgcctttgttggccgatgatcttcacatgaagcttctctacctggaaaacagagttgcattggctatattgttctttcctgctgaagccaaagtcgccatgcaaatcgcgcaagcagacaccacagaagaatttggtggtattactgcaccaggcactacagcaccaagtacttctggtaaactgagggaagtcgacctgaacgaaacaccagccatacaaaacaaaagactccgttcaagggtggatgcgctgatgaaaacagtgctcactcatatcatctggcattatgcagtggagcttggccggcggtacttcccgaactgctcgcaggtgctggacaagtacctggagtacaagtacctggagtacgacctgccggacgggctggaccagttctacctccagaggggcacccccgacgagcagaaggtgaagaggatgcgcttctgcgagctgaaggaggacgtccggaaggcgttcaccaaggacaaggccgacaacagcatgttctccggcctgtcgtcgtcgtcgtcgtgctcgccgccccagaagatcgccaagaag

SEQ ID NO: 868 - protein, 639 aa, Setaria italica
  Si000647m polypeptide
MEPSSSITFASSSSYLSNGSSPCSVALPPPGPPQAPPLTAGDGWGSGGAAGGSSSNVEAVSLNRLSKNLERLLIDEDLDCSDADIEVPDGGPPVPVHRCILAVRSPFFYDIFAARGRGGAARGDAAAGARGAGEGAASGRPRYKMEELVPGGRVGREAFQAFLGYLYTGKLRPAPLDVVSCADPVCPHDSCPPAIRFAVELMYAAWTFKIPELISLFQRRLLNFVDKTLVEDVIPILQVASHSELTQVLDKCIQRIARSNLDDISLDKELSPEVVEEIKKIRKKLQTADDDASISDPVHEKRVRRIHRALDSDDVELVKLLLNESEITLDDANALHYAASYCDSKVVSELLELGLANLNLKNSRGYTALHLAAMRREPAIIMCLLNKGATVSQLTADGRSAIGICRRLTRAKDYNTKMEQGQESNKDRLCIDILEREMMRNPMSVEDAVTSPLLADDLHMKLLYLENRVALAILFFPAEAKVAMQIAQADTTEEFGGITAPGTTAPSTSGKLREVDLNETPAIQNKRLRSRVDALMKTVLTHIIWHYAVELGRRYFPNCSQVLDKYLEYKYLEYDLPDGLDQFYLQRGTPDEQKVKRMRFCELKEDVRKAFTKDKADNSMFSGLSSSSSCSPPQKIAKK

SEQ ID NO: 869 - DNA, 1887 bp, Setaria italica
  Si000671m
atggagccgtcgtcgtccatcacgttcgcgtcctcgtcgtcgtacctgtccaacgggtccagcccctgctccgtcgcgctcccgccgccggggccgccccaggctcccccgttgaccgccggcgacgggtggggtagtggtggcgctgctggagggagcagcagcaacgtggaggcggtgagcctgaaccggctcagcaaaaacctcgagcggctcctcatcgacgaggacctcgactgcagcgacgccgacatcgaggtgcccgacggtgggccgcccgtccccgtccaccgctgtatactcgccgtgcggagccccttcttctacgacatcttcgccgcgcgcggccgcggaggcgcagcgcgaggtgatgctgccgccggtgccagaggggcgggagagggggctgccagtggcaggccgcggtacaagatggaggagctcgtccccggcggccgcgtggggcgcgaagccttccaggcgttcctgggctatctgtacaccggcaagctccggccggcaccgctcgatgtggtgtcttgtgctgaccccgtgtgccctcatgactcgtgcccgccggccatcaggttcgccgtcgagctcatgtatgcggcgtggaccttcaagatccccgagctcatttcgctgttccagcggcggcttcttaactttgtagacaagactctagtggaagatgtcattcctattctgcaagttgcttcacactcagagctgactcaagtgctcgacaaatgcattcagaggattgctagatcaaatcttgatgatatatctttggataaggagctttctccagaagttgtcgaggagataaaaaagattcgtaaaaagttgcaaactgctgatgatgacgcctccatttcggaccctgtgcatgagaaaagagtcagaagaatccacagagcactcgactctgatgatgttgagcttgtgaagttgcttcttaatgagtctgagatcacattagatgatgccaatgcattgcactatgcagcttcttactgtgattctaaggttgtctcggagttgttagagttggggctggctaacttgaatttgaagaatagccgtggatacacagcactccacttggctgctatgaggagagaaccagctatcattatgtgcctccttaacaaaggggcaactgtatcacaactgacagctgatggccggagtgcaattggtatttgtcggaggttaacaagagcaaaagactacaatacaaagatggagcagggtcaagagtcaaacaaagataggttgtgtatagatattctagagcgggagatgatgcgaaatcctatgtcagtggaagatgctgtcacctcgcctttgttggccgatgatcttcacatgaagcttctctacctggaaaacagagttgcattggctatattgttctttcctgctgaagccaaagtcgccatgcaaatcgcgcaagcagacaccacagaagaatttggtggtattactgcaccaggcactacagcaccaagtacttctggtaaactgagggaagtcgacctgaacgaaacaccagccatacaaaacaaaagactccgttcaagggtggatgcgctgatgaaaacagtggagcttggccggcggtacttcccgaactgctcgcaggtgctggacaagtacctggagtacaagtacctggagtacgacctgccggacgggctggaccagttctacctccagaggggcacccccgacgagcagaaggtgaagaggatgcgcttctgcgagctgaaggaggacgtccggaaggcgttcaccaaggacaaggccgacaacagcatgttctccggcctgtcgtcgtcgtcgtcgtgctcgccgccccagaagatcgccaagaag

SEQ ID NO: 870 - protein, 629 aa, Setaria italica
  Si000671m polypeptide
MEPSSSITFASSSSYLSNGSSPCSVALPPPGPPQAPPLTAGDGWGSGGAAGGSSSNVEAVSLNRLSKNLERLLIDEDLDCSDADIEVPDGGPPVPVHRCILAVRSPFFYDIFAARGRGGAARGDAAAGARGAGEGAASGRPRYKMEELVPGGRVGREAFQAFLGYLYTGKLRPAPLDVVSCADPVCPHDSCPPAIRFAVELMYAAWTFKIPELISLFQRRLLNFVDKTLVEDVIPILQVASHSELTQVLDKCIQRIARSNLDDISLDKELSPEVVEEIKKIRKKLQTADDDASISDPVHEKRVRRIHRALDSDDVELVKLLLNESEITLDDANALHYAASYCDSKVVSELLELGLANLNLKNSRGYTALHLAAMRREPAIIMCLLNKGATVSQLTADGRSAIGICRRLTRAKDYNTKMEQGQESNKDRLCIDILEREMMRNPMSVEDAVTSPLLADDLHMKLLYLENRVALAILFFPAEAKVAMQIAQADTTEEFGGITAPGTTAPSTSGKLREVDLNETPAIQNKRLRSRVDALMKTVELGRRYFPNCSQVLDKYLEYKYLEYDLPDGLDQFYLQRGTPDEQKVKRMRFCELKEDVRKAFTKDKADNSMFSGLSSSSSCSPPQKIAKK

SEQ ID NO: 871 - DNA, 1719 bp, Solanum lycopersicum
  Solyc07g044980.2.1
atggagagcggccatgagagttttgctacatcttctaatgtatcaaatgagtgcagtagtccccaggaaccaggaccaaatgttgatcatttgagtaatttatgtggtagtcttgagaaactcctgcttaatcctgaatatgactatagtgatgcagaaattgtcgttgaggggattaatgttggcgttaatcgctgtatattggctgcacgaagtcagtttttccatgaaaagtttaaggagaagaatgagaattccttgaaaaatgaaaagcctaaatatttgctgaaggatttggtgtgtgtttcctcaattggctatgaagtattcatggtcctcctgaattatttatatacaggaaagattaagtcgtctccttcagaagtttcgagttgtgttgataatgcttgtgctcatgatgcttgccgccctgccattaattatgcagtggaactcatgtatgcttcgtccacttttcagataaaagaactcgttatgttcgtagagcgctatctcgacaactttgttgataaggctactcctgaggatgtaattcctatacttttagttgcctttcaccgcaagtctaatcaacttcttgaacactgcatccagagagtggcacgatctgatctagacaatgctactcttgagaaagaactccctcatgaagttttgactgacataaaatcaaggcgcctcaagtctcgacaagggactgaacaggagtcattagactccttgagtgaaaagagaattaggaggattctgaaggctctggagtctgatgacattgaattgctaacactactcctggaagagtcaaacgtcactttaaatgatgcttgtgctcttcattatgcagctgcctattgcaactccaaggttgtgaacgaggtacttgagctgggtttaggcgctgatgtcaatcttcagaactcccgaggatataatgtcctacatgttgcagctagacgaaaggagccatcaataataatgggactacttgcaaaaggagcatccgtcttggatactacacgtgatggacatacagccctatccatatgccgtagattgactcggttaaaggattacaatgatccaccgaagcaaggaaaggttactaataaagaccggttatgcattgatgttttggagagagagatgattaggaatcctatgattgggagcatgtgttcttcatcattggtgttggctgatgaattactcatgaggttgcttttatttgaaaatagagtggcattggcacggatgttatttcctcaggaagccatgctagctatggaaatagcacatgctgattcaaccgcagagtttactggcctttcagcaacaaatggcttatgcaaaaatccgggaggggttgacttgaacaaattaccgtctgagcaagtgaaaagactccaagatcggctgggcgcactactgaaaacagtggacacaggtcgacgttttttcccaaactgctcggaagtattagatagattactggaggatgacaaactagattccttgatgttagaaagtggcacccctgaggaacaaagatcaaagaaaatgcgatacacagagctcaaggatgaagttatggaggcattcaagaaagacaaagctgaaaagaactgggcgggcttctctacgtcttcctcctcttcatgttctccaaagaccaatgtcagtcacaagaatagaaaaaag

SEQ ID NO: 872 - protein, 573 aa, Solanum lycopersicum
  Solyc07g044980.2.1 polypeptide
MESGHESFATSSNVSNECSSPQEPGPNVDHLSNLCGSLEKLLLNPEYDYSDAEIVVEGINVGVNRCILAARSQFFHEKFKEKNENSLKNEKPKYLLKDLVCVSSIGYEVFMVLLNYLYTGKIKSSPSEVSSCVDNACAHDACRPAINYAVELMYASSTFQIKELVMFVERYLDNFVDKATPEDVIPILLVAFHRKSNQLLEHCIQRVARSDLDNATLEKELPHEVLTDIKSRRLKSRQGTEQESLDSLSEKRIRRILKALESDDIELLTLLLEESNVTLNDACALHYAAAYCNSKVVNEVLELGLGADVNLQNSRGYNVLHVAARRKEPSIIMGLLAKGASVLDTTRDGHTALSICRRLTRLKDYNDPPKQGKVTNKDRLCIDVLEREMIRNPMIGSMCSSSLVLADELLMRLLLFENRVALARMLFPQEAMLAMEIAHADSTAEFTGLSATNGLCKNPGGVDLNKLPSEQVKRLQDRLGALLKTVDTGRRFFPNCSEVLDRLLEDDKLDSLMLESGTPEEQRSKKMRYTELKDEVMEAFKKDKAEKNWAGFSTSSSSSCSPKTNVSHKNRKK

SEQ ID NO: 873 - DNA, 1866 bp, Brachypodium distachyon
  Bradi2g51030.1
atggagccgtcgtcgtccatcacgttcgcctcatcgtcgtcctatctgtccaacggctccagcccctactccgccgctttgccgcctccgggggctacccaggcggcgccgctgaccccctcggaggggtatggcgggggaggaggaggcggagggagcagcagcctggaggtagtgagcctgaatcggctcagcaacaacctcgagcgtctcctcctcgagtctgacctcgactgcagcgacgccgacgtcgacatggccgatggtgggcctctcgttcccgtccatcgctgcatcctcgccgcacgcagcccgttcttccacgaattcttcgcggcacgcggccgtggaaacagtggagacggtccaccctctgcctccgctgccggcgtcggagggggaggagaaggcactgggaggccgcggtataagatggaggagctcgtcccggggggccgtgtggggcgcgaggctttcctggggttcatgcgatacctgtacacgggcaagctccgccccgcaccgccggacgtggtgtcatgtgttgatcctgtgtgcccacacgactcttgcccgccggccatcaggttcgccgttgagctcatgtacgcggcgtcgacctttaacatccccgagctcatctcgctgttccagcgacgactccttaattttgttgacaagactctagtggaagatgtccttcctattttgcaagttgcttacgactcagatcttggtcaagtgctcgaaaaatgtgttcagaggattgtaagatcagatcttgataacatatctttggataaggaagtctgtccagaagttgctgataagataaaaaagatcagacaaaaatctccgcctgatgatggtgacaccgtaattttggatcctgtacacgagaaaagagtaagaaggatccacagggcactggattctgatgatgtcgaacttgtgaagttgcttctcaatgagtctgaaatcaccttagatgatgccaatgcattacattatgcagctgcttactgtgattcaaaagttgtttcggaattgttagacttgggactggccaacttgaatttgaagaataatcgcggatacacagcacttcacctggctgctatgagaagagaaccgactattattatgtgtctactaaacaaaggagcggtggcatcacaattgacatgcgatggccgacttgcaagtagtatatgccggaggttaacaagggcaaaagactacaatacaaagatggagcagggccaagagtcgaataaagataagatgtgtattgatatgctagagcgggagatgaggaggaatcctatgccagtggaagattctgtcacctcacctctattggctgatgatcttcacatgaaactaaactacctggaaatcagagttgcatttgcaagattattcttccctgctgaagcaaaagttgccatgcaaattgcacaagcagacatcacaccagaagttaccggtgtttctgcagcaagtacttctggtaaactgaaggaagtcgatctgaatgagacaccagtaacacagaacaaaaggctccggtcaagggtcgatgcactagtgaaaacagtggagctgggccgccggtactttccgagctgctctgaggtgctcgacaaatatctggaagatgacttgcccgatggtctggacattttccaccagcaaagtggcacccccgatgagcagaaggtgaaaaagatgcggttctgcgaggtaaaagaggatgtgcgcaaggcattcagcaaagacacggccgataaaagcgcgttttcagccctgtcatcgaactcctcgtcctctccgccgccgccgcctcagaagattgcacagaag

SEQ ID NO: 874 - protein, 622 aa, Brachypodium distachyon
  Bradi2g51030.1 polypeptide
MEPSSSITFASSSSYLSNGSSPYSAALPPPGATQAAPLTPSEGYGGGGGGGGSSSLEVVSLNRLSNNLERLLLESDLDCSDADVDMADGGPLVPVHRCILAARSPFFHEFFAARGRGNSGDGPPSASAAGVGGGGEGTGRPRYKMEELVPGGRVGREAFLGFMRYLYTGKLRPAPPDVVSCVDPVCPHDSCPPAIRFAVELMYAASTFNIPELISLFQRRLLNFVDKTLVEDVLPILQVAYDSDLGQVLEKCVQRIVRSDLDNISLDKEVCPEVADKIKKIRQKSPPDDGDTVILDPVHEKRVRRIHRALDSDDVELVKLLLNESEITLDDANALHYAAAYCDSKVVSELLDLGLANLNLKNNRGYTALHLAAMRREPTIIMCLLNKGAVASQLTCDGRLASSICRRLTRAKDYNTKMEQGQESNKDKMCIDMLEREMRRNPMPVEDSVTSPLLADDLHMKLNYLEIRVAFARLFFPAEAKVAMQIAQADITPEVTGVSAASTSGKLKEVDLNETPVTQNKRLRSRVDALVKTVELGRRYFPSCSEVLDKYLEDDLPDGLDIFHQQSGTPDEQKVKKMRFCEVKEDVRKAFSKDTADKSAFSALSSNSSSSPPPPPQKIAQK

SEQ ID NO: 875 - DNA, 1905 bp, Oryza sativa
  LOC_Os01g56200.1
atgccggcgcgtagcgcggtggtggtaatagccatggagccctcgtcgtccatcaccatcgcgtcgtcgtcctcgtacctctcgaacgggtctagcccgtgctcggtctctcttgcgccgccgggggcaggggcggtggcggcgcaggcggcgccggttgccgccggggagggcggcggcggcggaggaggaggaggaggaggagggagtagtagcgtggaggtggtgagcctgaatcggcttagcgctaacctcgagcggctcctcctcgattccgacctcgactgcagcgacgccgacgtcgacgtggccgacggtggcccgcccgtgccagtccaccgctgcatcctcgccgcccgcagcaccttcttctacaacctcttcgcggcgcgcggccgcggcggcgatggggctgccggcggcggcggcggcggcggtggtgggggaggggagaggactggggggaggccgcggtacaagatggaggagctcgtgccgggaggccgcgtggggcgcgatgccttcctgtcgctgctgggttacctgtacacgggcaagctccggccggcgccggatgacgtggtgtcctgcgccgaccccatgtgcccgcacgactcgtgcccgccggcgatcaggttcaacgtcgagcaaatgtacgcggcgtgggcgttcaagatcaccgagctcatctcgctgttccagcgacggcttcttaacttcgtcgataagactctagtagaagatgttcttccaattctgcaagttgcttttcattcagagctgactccagtgcttgaaaaatgtattcggagaattgcaagatcaaatcttgataatgtatcgttggataaggaacttcctccagaagttgctgttcagataaaagagattcgccaaaaatctcagccaaatgagggtgacaccgtcatttcagaccctgtacatgagaaaagggtcagaagaatccacagggcactggattctgatgatgttgagcttgtgaagttgcttcttaacgaatctgagatcaccttggatgatgccaatgcattgcactatgctgctgcttactgtgattcgaaagttgtttcggagttgttagacttgagacttgccaacttgaatttgaagaattcgcgtggatacacggcactccatctggctgctatgaggagagagccagctattatcatgtgtctcctaaacaaaggagcagctgtatcacaattgactgctgatggccagagtgcaatgagtatctgccggaggttaacaaggatgaaagactacaatacaaagatggagcaaggccaagagtcaaacaaagacagattatgtattgatatattagatagggagatgataaggaaacctatggcagtggaagattctgtcacctcgcctttgttggctgacgatcttcacatgaagcttctctaccttgaaaacagagttgcatttgcaagattattttttcctgcagaagcaaaggttgcaatgcaaattgcacaagcagacaccacaccagaatttggcattgttcctgcagctagcacttctggaaaattgaaggaagtcgatctgaacgagacaccagtaacacaaaacaaaaggctccgttcaagggtggatgcactcatgaaaacagttgagctgggacgtcgctacttccctaactgctcgcaggtgctcgacaaatttctggaggatgatttgcccgatagtcctgatgcactcgacctccaaaatggcacttctgatgagcaaaatgttaaaaggatgcggttctgtgagttaaaggaggatgtgcgcaaggcattcagcaaagacagagctgataatagcatgttttctatcttgtcatcttcatcgtcatcttcgccacctcccaaggttgcaaagaaa

SEQ ID NO: 876 - protein, 635 aa, Oryza sativa
  LOC_Os01g56200.1 polypeptide
MPARSAVVVIAMEPSSSITIASSSSYLSNGSSPCSVSLAPPGAGAVAAQAAPVAAGEGGGGGGGGGGGGSSSVEVVSLNRLSANLERLLLDSDLDCSDADVDVADGGPPVPVHRCILAARSTFFYNLFAARGRGGDGAAGGGGGGGGGGGERTGGRPRYKMEELVPGGRVGRDAFLSLLGYLYTGKLRPAPDDVVSCADPMCPHDSCPPAIRFNVEQMYAAWAFKITELISLFQRRLLNFVDKTLVEDVLPILQVAFHSELTPVLEKCIRRIARSNLDNVSLDKELPPEVAVQIKEIRQKSQPNEGDTVISDPVHEKRVRRIHRALDSDDVELVKLLLNESEITLDDANALHYAAAYCDSKVVSELLDLRLANLNLKNSRGYTALHLAAMRREPAIIMCLLNKGAAVSQLTADGQSAMSICRRLTRMKDYNTKMEQGQESNKDRLCIDILDREMIRKPMAVEDSVTSPLLADDLHMKLLYLENRVAFARLFFPAEAKVAMQIAQADTTPEFGIVPAASTSGKLKEVDLNETPVTQNKRLRSRVDALMKTVELGRRYFPNCSQVLDKFLEDDLPDSPDALDLQNGTSDEQNVKRMRFCELKEDVRKAFSKDRADNSMFSILSSSSSSSPPPKVAKK

SEQ ID NO: 877 - DNA, 1752 bp, Brachypodium distachyon
  Bradi1g12870.1
atggagacgtcgaccgttacctcctcctcttcgccgcccccatccccatccccgtccccgtccccgcaggccccgcaggctccgccggccaacctcgacgccgtcagcctcggccgcctcagcgccaacctcgagcgcctcctcgacccggccttcctcaactgcgcggacgccgaggtcgtccttgcggatggaggcgacgaagccaccgtccccgtccaccgctgcatccttgccgccaggagcaacttctttctcgaccacttctcctcgctctcctcccccgccgccggcggcggcaagccgcggctggagcttgccgagctggtcccaggcgggcgccacgtcggccacgaagccctcgtggccgttctcgggtacctctacactgggcgcctcaagccgccgccgcaggaggccgccatctgcgtcgacgaccggtgcaggcaccaggcgtgccgtccggcgatagacttcgttgttgagtccacgtacgccgcctccggcttccagatctccgagctcgtctcgctcttccagcgtcgcctgtccgactttgttaacgaagctctggcggaggatatcttgccgattattcatgttgcttccacctgccagcttccagacctgctcaatcaatgtattcaaagggttgcagactcgagtgttgacaggcattaccttgagaaggaacttccaggtgaagcattttccagggtcaaggagattcgtcggtattccctgcatgatgaaacagatgagtccactctggaccctgagcatgccaagagggtaaggaacattcacaaggccttggattctgatgatgttgcccttgttggcatgctcctaaaagaatctgcaatcactctggatgatgcacatgccatacactatgctgctgcctattgtgagcccaaagtgttggctggaatgctgaatctggactccgctaacgtgaacctgaagaatgacagtggatatacaccactgcatatagcttgcatgaggcgagaaccagatatcattgtttcacttatagagaagggagcttccgtgctggaaaggacacgagatggacgtgatgctcttaccatttgcaagagattaacaagggagaaagactgccgcaagaagttagagaaatgtaaggagagaagcaaggcctacttgtgcattgacatcttggagcaggtgattaagacaaagtcgtccatctcagaggagcgtctatgtgaagaggttcaaattgccactcctttgctggcagataattttcacatgagactcttgaacttggaaaacagagtttcctttgcaagaatatttttcccttccgaagccaagcttgtcatgcgcatagcacaagctgactcaaccgaagagtttactggtctcacattggctaatttcgctaaactgaaggatgacctaaatgacctcaagttgcgtgaacgctttgacgcgttgacaaagacagttgaactagggcgagggtatttcccgcattgttcagaagttcttgataagttcctgaacgaagaatccactgagttgttcttccttgaaactggcactcccgaggaccaacgaatcaagaggatgcgcttttctgaactcaaagaggatgtgctgaaggccttcagtaaagataaggcagttgcagccatagcttcctcaacgtcctcatcttcttcgccgaggtatgacggaaaggttaggcatggcaataagagagcaaagctattgcgg

SEQ ID NO: 878 - protein, 584 aa, Brachypodium distachyon
  Bradi1g12870.1 polypeptide
METSTVTSSSSPPPSPSPSPSPQAPQAPPANLDAVSLGRLSANLERLLDPAFLNCADAEVVLADGGDEATVPVHRCILAARSNFFLDHFSSLSSPAAGGGKPRLELAELVPGGRHVGHEALVAVLGYLYTGRLKPPPQEAAICVDDRCRHQACRPAIDFVVESTYAASGFQISELVSLFQRRLSDFVNEALAEDILPIIHVASTCQLPDLLNQCIQRVADSSVDRHYLEKELPGEAFSRVKEIRRYSLHDETDESTLDPEHAKRVRNIHKALDSDDVALVGMLLKESAITLDDAHAIHYAAAYCEPKVLAGMLNLDSANVNLKNDSGYTPLHIACMRREPDIIVSLIEKGASVLERTRDGRDALTICKRLTREKDCRKKLEKCKERSKAYLCIDILEQVIKTKSSISEERLCEEVQIATPLLADNFHMRLLNLENRVSFARIFFPSEAKLVMRIAQADSTEEFTGLTLANFAKLKDDLNDLKLRERFDALTKTVELGRGYFPHCSEVLDKFLNEESTELFFLETGTPEDQRIKRMRFSELKEDVLKAFSKDKAVAAIASSTSSSSSPRYDGKVRHGNKRAKLLR

SEQ ID NO: 879 - DNA, 1719 bp, Oryza sativa
  LOC_Os03g46440.3
atggagacgtccaccataagcttctcctcctcgtcgccgccgtcccctccgccgccgcagccggctccgggcgacatcgacgccgtcagcctcggccgcctcagcaggaacctcgagaacctcctcgaccccgcctttctcaactgcgccgacgccgagatcgtcctcgcctccggaggcggcgaccccggcggcggcgccgtcgtgggcgtccaccgctgcatcctcgccgccaggagccgcttcttctacgaccacttctcctccgcccccgcccccgcccccgccaccgccggcgacaagccgcagctggacctcgacgggctggtccccggcgggcgccacatcggccgagacgccctcgtcgccgttctcagctacctgtacaccggccgcctcaggtcggcgccccccgaggccgccgcctgcctggacgacggctgcagccacgacgcgtgccgcccggcgatcgacttcgtcgtcgagtccacgtacgccgcctccggcttccagatctccgagctcgtctccctcttccagcgccgattatctgattttgtgaacaaagctttggctgaggacatactgccaattcttgtggttgcctccacctgccatcttccagagctgctaaatcaatgtatccagagggttgccaactcgaacctggacaatcgttacctcgagaagcggcttccggatgatctgtacgccaagctgaaggagtttcgcgtgcctgatgaaccacacagtggcattcttgaccctgagcatgagaagagggtcagaaacatccacaaggccttggattccgatgatgtcgatcttgttggcatgcttctgaaggagtccccggtcaccttggatgatgcattcgccatacactacgctgcggcctactgtgagccaaaagtgttagcagaattgctgaaactggaatctgcaaatgtgaacctgaagaactcaagtggatacacgccgctccacatggcttgcatgaggcgagaaccggatatcattgtttcgcttatagaaaagggggcctctgttctggaaaggacacaggatggacgtgatgctcttaccatctgcaagagattaacaagggagaaagaccgcaacgagaaatcagaaaaatgcaaggagagaagcaaggcttacttgtgcattggcgtcttacagcaagaaataaagaggagaccacaaattttggaggaccagatgtctgcagaggagtcaattgctacacctctgctggttgataattttcacatgaggctactaaacttggagaatagagttgcctttgcaagaatatttttcccttcggaagccaaacttgtgatgcgcatagcacaagctgactcaactcaagagtttgctggtctcacatctgctaatttcagtaaacttaaggaggttgacctaaatgagacccccacaatgcaaaacaggaggttgcgagaacgccttgatgctttgacaaaaacagttgaactcggacgacgatacttcccacattgttcagaagttctcgacaagttcctgaatgaagaatccaccgatttgatcttgcttgaaagtggcacagcagaggaccagcaaaccaagaggatgcgcttttctgaactcagagaggatgtacggaaggcctttaccaaagataaggcagccggcgctgcaatatcttcctcaacatctgcgtcttcatcaccaagt

SEQ ID NO: 880 - protein, 573 aa, Oryza sativa
  LOC_Os03g46440.3 polypeptide
METSTISFSSSSPPSPPPPQPAPGDIDAVSLGRLSRNLENLLDPAFLNCADAEIVLASGGGDPGGGAVVGVHRCILAARSRFFYDHFSSAPAPAPATAGDKPQLDLDGLVPGGRHIGRDALVAVLSYLYTGRLRSAPPEAAACLDDGCSHDACRPAIDFVVESTYAASGFQISELVSLFQRRLSDFVNKALAEDILPILVVASTCHLPELLNQCIQRVANSNLDNRYLEKRLPDDLYAKLKEFRVPDEPHSGILDPEHEKRVRNIHKALDSDDVDLVGMLLKESPVTLDDAFAIHYAAAYCEPKVLAELLKLESANVNLKNSSGYTPLHMACMRREPDIIVSLIEKGASVLERTQDGRDALTICKRLTREKDRNEKSEKCKERSKAYLCIGVLQQEIKRRPQILEDQMSAEESIATPLLVDNFHMRLLNLENRVAFARIFFPSEAKLVMRIAQADSTQEFAGLTSANFSKLKEVDLNETPTMQNRRLRERLDALTKTVELGRRYFPHCSEVLDKFLNEESTDLILLESGTAEDQQTKRMRFSELREDVRKAFTKDKAAGAAISSSTSASSSPS

SEQ ID NO: 881 - DNA, 1764 bp, Setaria italica
  Si034834m
atggaggcctccaccattagcttctcgtccccgtcctcgtcgccccagtccacgccgccgccgccgccgccgcgggccacgccgaccgagctcgaggccgtcaggctccgccgcctcagcgacaacctcgagcgcctcctcgacccggccttcctcgactgcgcggacgccgaggtcgcgctcgccgcggggaagggcggcgccgccgtcggcgtccaccgctgcatcctcgccgctaggagcgccttcttccgcgaccacttcgcctccctcccgccgcctgccgccgttggagagaaaccacggctggagctcgccgacctggtccccgggggccgccacatcggccaggacgccctcgtgcccgtcctcgggtacctctacaccggccgcctcaagtcggcgccgcaggatgccaccgtctgcatggacgacgcgtgcggacacggggcgtgccgaccggcgattgactttgtcgtcgagtccatgtacgccgcatctggcttccagatctccgagcttgtctccctcttccagcgccgtctctcggactttgttagcacagctctggacgaagatgtggtgccgattgttcatgttgcttccacctgtgagcttcaggacctgctcaatcagagtcttcagaggattgcagtctctagtctcgatagccggtacctcgagaaggagcttccagatgatatatactgcaagatcaaggaaatccgccagagtgtgtttcatgatgaatcagagaacgctattctggaccctgagcatgagaagagggttagaaacatcctcaaggccttggattctgacgatgttgaccttgttggcttgctgttaaaggagtctgcagtcaccttggatgatgcattcgctgtacactatgctgcagcctactgtgagcctaaagtgtttgcggaattgttgaaactgaattctgccaatgtgaatctgaagaataacagtgggtatacaccgctgcacatagcttgcatgaggcgagaaccggatatcattctttcgcttgtggagaggggagcctctgtgatggagaggaccccggatgggcgtgatgcttttactatttgcaagagactaacaagagagaaagactgcaacaggaagttggagaagtgcgaggagaaaagcaaggcttacttgtgtatcgacatattggagcaagaacttaagaggaaatccttcattttggaccagatctccatagaggagtcaattgccacacctttgctggttgataattttcacatgaggctcataaacttggaaaacagagttgcctttgcaagaatattcttcccgtctgaagccaagcttgtcatgcgcatagcacaagctgactcaactgaagagtttgctggcatcagaaatttcagtaaactgaaggaggtggatctaaatgagacccccacgatgcaaaacaagaggttgcgtgaacgcctcgatgccttaacaaagacagttgagcttgggaggcgatacttccctcattgttcagatgttcttgacaagttcctcattgaagaatccaccgatttgatttaccttgaaactggcactccagaggaccagcatctcaagcggatgcgcttctctgaactcaaagaggacgtgcgcaaggccttcacaaaagataaggcagctgttacagccatagcttcctcagcatcctcatcttcgtcttcaaggtacgaagggaggggtagacaatccaacaggaaatcgaaacaatcacga

SEQ ID NO: 882 - protein, 588 aa, Setaria italica
  Si034834m polypeptide
MEASTISFSSPSSSPQSTPPPPPPRATPTELEAVRLRRLSDNLERLLDPAFLDCADAEVALAAGKGGAAVGVHRCILAARSAFFRDHFASLPPPAAVGEKPRLELADLVPGGRHIGQDALVPVLGYLYTGRLKSAPQDATVCMDDACGHGACRPAIDFVVESMYAASGFQISELVSLFQRRLSDFVSTALDEDVVPIVHVASTCELQDLLNQSLQRIAVSSLDSRYLEKELPDDIYCKIKEIRQSVFHDESENAILDPEHEKRVRNILKALDSDDVDLVGLLLKESAVTLDDAFAVHYAAAYCEPKVFAELLKLNSANVNLKNNSGYTPLHIACMRREPDIILSLVERGASVMERTPDGRDAFTICKRLTREKDCNRKLEKCEEKSKAYLCIDILEQELKRKSFILDQISIEESIATPLLVDNFHMRLINLENRVAFARIFFPSEAKLVMRIAQADSTEEFAGIRNFSKLKEVDLNETPTMQNKRLRERLDALTKTVELGRRYFPHCSDVLDKFLIEESTDLIYLETGTPEDQHLKRMRFSELKEDVRKAFTKDKAAVTAIASSASSSSSSRYEGRGRQSNRKSKQSR

SEQ ID NO: 883 - DNA, 1767 bp, Oryza sativa
  LOC_Os03g46440.1
atggagacgtccaccataagcttctcctcctcgtcgccgccgtcccctccgccgccgcagccggctccgggcgacatcgacgccgtcagcctcggccgcctcagcaggaacctcgagaacctcctcgaccccgcctttctcaactgcgccgacgccgagatcgtcctcgcctccggaggcggcgaccccggcggcggcgccgtcgtgggcgtccaccgctgcatcctcgccgccaggagccgcttcttctacgaccacttctcctccgcccccgcccccgcccccgccaccgccggcgacaagccgcagctggacctcgacgggctggtccccggcgggcgccacatcggccgagacgccctcgtcgccgttctcagctacctgtacaccggccgcctcaggtcggcgccccccgaggccgccgcctgcctggacgacggctgcagccacgacgcgtgccgcccggcgatcgacttcgtcgtcgagtccacgtacgccgcctccggcttccagatctccgagctcgtctccctcttccagcgccgattatctgattttgtgaacaaagctttggctgaggacatactgccaattcttgtggttgcctccacctgccatcttccagagctgctaaatcaatgtatccagagggttgccaactcgaacctggacaatcgttacctcgagaagcggcttccggatgatctgtacgccaagctgaaggagtttcgcgtgcctgatgaaccacacagtggcattcttgaccctgagcatgagaagagggtcagaaacatccacaaggccttggattccgatgatgtcgatcttgttggcatgcttctgaaggagtccccggtcaccttggatgatgcattcgccatacactacgctgcggcctactgtgagccaaaagtgttagcagaattgctgaaactggaatctgcaaatgtgaacctgaagaactcaagtggatacacgccgctccacatggcttgcatgaggcgagaaccggatatcattgtttcgcttatagaaaagggggcctctgttctggaaaggacacaggatggacgtgatgctcttaccatctgcaagagattaacaagggagaaagaccgcaacgagaaatcagaaaaatgcaaggagagaagcaaggcttacttgtgcattggcgtcttacagcaagaaataaagaggagaccacaaattttggaggaccagatgtctgcagaggagtcaattgctacacctctgctggttgataattttcacatgaggctactaaacttggagaatagagttgcctttgcaagaatatttttcccttcggaagccaaacttgtgatgcgcatagcacaagctgactcaactcaagagtttgctggtctcacatctgctaatttcagtaaacttaaggaggttgacctaaatgagacccccacaatgcaaaacaggaggttgcgagaacgccttgatgctttgacaaaaacagttgaactcggacgacgatacttcccacattgttcagaagttctcgacaagttcctgaatgaagaatccaccgatttgatcttgcttgaaagtggcacagcagaggaccagcaaaccaagaggatgcgcttttctgaactcagagaggatgtacggaaggcctttaccaaagataaggcagccggcgctgcaatatcttcctcaacatctgcgtcttcatcaccaaggtatgagacaaagttaagacctggcaacaagaaagggaagctatcacgg

SEQ ID NO: 884 - protein, 589 aa, Oryza sativa
  LOC_Os03g46440.1 polypeptide
METSTISFSSSSPPSPPPPQPAPGDIDAVSLGRLSRNLENLLDPAFLNCADAEIVLASGGGDPGGGAVVGVHRCILAARSRFFYDHFSSAPAPAPATAGDKPQLDLDGLVPGGRHIGRDALVAVLSYLYTGRLRSAPPEAAACLDDGCSHDACRPAIDFVVESTYAASGFQISELVSLFQRRLSDFVNKALAEDILPILVVASTCHLPELLNQCIQRVANSNLDNRYLEKRLPDDLYAKLKEFRVPDEPHSGILDPEHEKRVRNIHKALDSDDVDLVGMLLKESPVTLDDAFAIHYAAAYCEPKVLAELLKLESANVNLKNSSGYTPLHMACMRREPDIIVSLIEKGASVLERTQDGRDALTICKRLTREKDRNEKSEKCKERSKAYLCIGVLQQEIKRRPQILEDQMSAEESIATPLLVDNFHMRLLNLENRVAFARIFFPSEAKLVMRIAQADSTQEFAGLTSANFSKLKEVDLNETPTMQNRRLRERLDALTKTVELGRRYFPHCSEVLDKFLNEESTDLILLESGTAEDQQTKRMRFSELREDVRKAFTKDKAAGAAISSSTSASSSPRYETKLRPGNKKGKLSR

SEQ ID NO: 885 - DNA, 1749 bp, Oryza sativa
  LOC_Os03g46440.2
atggagacgtccaccataagcttctcctcctcgtcgccgccgtcccctccgccgccgcagccggctccgggcgacatcgacgccgtcagcctcggccgcctcagcaggaacctcgagaacctcctcgaccccgcctttctcaactgcgccgacgccgagatcgtcctcgcctccggaggcggcgaccccggcggcggcgccgtcgtgggcgtccaccgctgcatcctcgccgccaggagccgcttcttctacgaccacttctcctccgcccccgcccccgcccccgccaccgccggcgacaagccgcagctggacctcgacgggctggtccccggcgggcgccacatcggccgagacgccctcgtcgccgttctcagctacctgtacaccggccgcctcaggtcggcgccccccgaggccgccgcctgcctggacgacggctgcagccacgacgcgtgccgcccggcgatcgacttcgtcgtcgagtccacgtacgccgcctccggcttccagatctccgagctcgtctccctcttccagcgccgattatctgattttgtgaacaaagctttggctgaggacatactgccaattcttgtggttgcctccacctgccatcttccagagctgctaaatcaatgtatccagagggttgccaactcgaacctggacaatcgttacctcgagaagcggcttccggatgatctgtacgccaagctgaaggagtttcgcgtgcctgatgaaccacacagtggcattcttgaccctgagcatgagaagagggtcagaaacatccacaaggccttggattccgatgatgtcgatcttgttggcatgcttctgaaggagtccccggtcaccttggatgatgcattcgccatacactacgctgcggcctactgtgagccaaaagtgttagcagaattgctgaaactggaatctgcaaatgtgaacctgaagaactcaagtggatacacgccgctccacatggcttgcatgaggcgagaaccggatatcattgtttcgcttatagaaaagggggcctctgttctggaaaggacacaggatggacgtgatgctcttaccatctgcaagagattaacaagggagaaagaccgcaacgagaaatcagaaaaatgcaaggagagaagcaaggcttacttgtgcattggcgtcttacagcaagaaataaagaggagaccacaaattttggaggaccagatgtctgcagaggagtcaattgctacacctctgctggttgataattttcacatgaggctactaaacttggagaatagagttgcctttgcaagaatatttttcccttcggaagccaaacttgtgatgcgcatagcacaagctgactcaactcaagagtttgctggtctcacatctgctaatttcagtaaacttaaggaggttgacctaaatgagacccccacaatgcaaaacaggaggttgcgagaacgccttgatgctttgacaaaaacagttgaactcggacgacgatacttcccacattgttcagaagttctcgacaagttcctgaatgaagaatccaccgatttgatcttgcttgaaagtggcacagcagaggaccagcaaaccaagaggatgcgcttttctgaactcagagaggatgtacggaaggcctttaccaaagataaggcagccggcgctgcaatatcttcctcaacatctgcgtcttcatcaccaaggcgagagcggagggggagatcgcgtcgcgcg

SEQ ID NO: 886 - protein, 583 aa, Oryza sativa
  LOC_Os03g46440.2 polypeptide
METSTISFSSSSPPSPPPPQPAPGDIDAVSLGRLSRNLENLLDPAFLNCADAEIVLASGGGDPGGGAVVGVHRCILAARSRFFYDHFSSAPAPAPATAGDKPQLDLDGLVPGGRHIGRDALVAVLSYLYTGRLRSAPPEAAACLDDGCSHDACRPAIDFVVESTYAASGFQISELVSLFQRRLSDFVNKALAEDILPILVVASTCHLPELLNQCIQRVANSNLDNRYLEKRLPDDLYAKLKEFRVPDEPHSGILDPEHEKRVRNIHKALDSDDVDLVGMLLKESPVTLDDAFAIHYAAAYCEPKVLAELLKLESANVNLKNSSGYTPLHMACMRREPDIIVSLIEKGASVLERTQDGRDALTICKRLTREKDRNEKSEKCKERSKAYLCIGVLQQEIKRRPQILEDQMSAEESIATPLLVDNFHMRLLNLENRVAFARIFFPSEAKLVMRIAQADSTQEFAGLTSANFSKLKEVDLNETPTMQNRRLRERLDALTKTVELGRRYFPHCSEVLDKFLNEESTDLILLESGTAEDQQTKRMRFSELREDVRKAFTKDKAAGAAISSSTSASSSPRRERRGRSRRA

SEQ ID NO: 887 - DNA, 1704 bp, Zea mays
  GRMZM2G115162_T01
atggaggtctccaccatcagcttctcgtccccgccgccgcgggccacgccggccgacctcgaggccgtcggcctccgccgcctcagcgacaacctccagcgcctgctcgacccggccttcctcaactgctcggacgccgagatcgcgctcgccgcggcgaggggcggcggcgccgtcggcgtccaccgctgcatcctcgccgccaggagcgccttcttcctcgaccacctcgcctccctcccggctccggccgccgccggcgagaggccacggctggagctcgccgacctcgtcccgggcggccgccacatcggccgcgacgccctcgtgcccgtcctcggctatctctacaccggccgcctcaagcccccggcgcaggacgccaccgtctgcatggacgacgcgtgcggccacgggacttgccgcccggccatagatttcgtcgtcgagtccatgtacgcggcgtctggcttccagatctcggagcttgcctccctcttccagcgtcgcctctctgacttcgtttgcgaagcgctggacgaggacgtggtgccgattattcatgtcgcttccacctgcgatctccaggacctgctcaatctgtgtattcagagggtcgcagtctccgctctcgatagccgctacctggacaaggagcttccggctgacatatacaacaagatcaaggagatccgccgccaaccagagaacgccattattctggaccctgagcatgacaagagggtcaggaacatcctcaaggccttggattccgacgacgtcgatctcgtcggcttgctgttgaaggaatcgacggtgaccttggacgatgcattcgcgatacactatgctgcagcctactgtgagcccaaggtgtttgcagagctgctcaaactggactctgctaacgtgaacctgaagaacagcggtgggtatacgccgctgcacatagcttgcatgaggagagagccggacatcattctttcgctggtggagaggggagcctgtgtgctggagaggaccctggatgggcgcgatgctcttactatctgcaagagactgacaagagagaaagactgcaataggaagttggacaagtacgaggagaaaagtaaggcttacttgtgtatcgacattttggagcaagaactcaagaggaaatccttcgttttggaccccatctctatctctatagaggagtcgattgccacgcctttgctggtcgataattttcacatgaggctcataaacttggaaaacagagttgcgtttgctcggatattcttcccttctgaagccaagcttgtcatgcgcatcgcacaagccgattcaacccaagagtttgccggcatcaccaacttcagcagactcaaggaagttgatctaaacgaaaccccaacgatgcagaataggaggcttcgcgaacgccttgatgccttaacaaagacagttgagctagggagacgatacttcccacactgttcggacgttctggataagttcctcaacgaagaatccactgatccgatcttccttgagactgggaccccggaggatcagcaagtcaagaggatgcgtttctctgagctcagagaggacgtgcgcaaggcgttcacgaaagataaggcagcagtggctgcaatagcttcctcggcgtcctcgtcttcgtctccgaggtgcagacgacccaataggaaatcacgg

SEQ ID NO: 888 - protein, 568 aa, Zea mays
  GRMZM2G115162_T01 polypeptide
MEVSTISFSSPPPRATPADLEAVGLRRLSDNLQRLLDPAFLNCSDAEIALAAARGGGAVGVHRCILAARSAFFLDHLASLPAPAAAGERPRLELADLVPGGRHIGRDALVPVLGYLYTGRLKPPAQDATVCMDDACGHGTCRPAIDFVVESMYAASGFQISELASLFQRRLSDFVCEALDEDVVPIIHVASTCDLQDLLNLCIQRVAVSALDSRYLDKELPADIYNKIKEIRRQPENAIILDPEHDKRVRNILKALDSDDVDLVGLLLKESTVTLDDAFAIHYAAAYCEPKVFAELLKLDSANVNLKNSGGYTPLHIACMRREPDIILSLVERGACVLERTLDGRDALTICKRLTREKDCNRKLDKYEEKSKAYLCIDILEQELKRKSFVLDPISISIEESIATPLLVDNFHMRLINLENRVAFARIFFPSEAKLVMRIAQADSTQEFAGITNFSRLKEVDLNETPTMQNRRLRERLDALTKTVELGRRYFPHCSDVLDKFLNEESTDPIFLETGTPEDQQVKRMRFSELREDVRKAFTKDKAAVAAIASSASSSSSPRCRRPNRKSR

SEQ ID NO: 889 - DNA, 1848 bp, Citrus clementina
  clementine0.9_005201m
atggaaaatgcgaacgaaaagtcagcatctttgagttttgtctcatcatatccgacttgttggtccactaatcaatcaacagacacttgtgatcttgatgatttgaatatggttcttgatggtatcatggaaaatgcgaacgaaaagtcagcatctttgagttttgtctcatcaaatccgacttgttggtccactaatcaatcaacagacacttgtgatcttgatgatttgaacttaaggatgcaaagcagcaatcccaaagagacatggcatgacgctgagattgttgttgagggcaaatcagtggcggttaatcgcagcatattgtctgagcgcagtcaattttttcgtcggctttttaatttgagaaatgatggttctgtcagtgaggggaaacccaagtatcttttgactgatttggtgcctcatgggaaggttggatatgaagctttcaatgataccttgcattatatttacactgggaagacaaaggcacctcctccagaagtgtccacgtgtgttgatgatgcttgtgttcatgtttcttgccctcctactattaattatgttattgagttgatgtatgcttctgctgctcttcagatgaaaaaactcgttattcgtttagagctttggcttctgaacttggttgagaaggctcttgtggaagatgtaatcccaattctcgtggctgccttgcattgccaactgaaccacctccgttctttctgcatccagagaattgcaaagtcaaatcttgacaatgtttgtctcgagaaagagcttcctgatgaagtttcaagtgaaatcaaatcactccgtgtcaaatctaaccaggagtctgaagctaatatagcagaagtggaccctatgcatgcaaaaatagtcagaagaatccacaaggcgctggactctgatgacgttgaactgttgaagcttcttctggatgtatctaatgtcactctggatgatgcttacgccctgcactatgctgctgcctactgcagccctaaggttttcaaggaagtgctcaatatggacttggcttgtctcaatcttaaggatgcaagaggacgtacggtgcttcatgtggctgcaaggcgtaatgagccagaagtgatggtgactctgctgagcaagggagcatgcgcatcagaaactacatcagatgggcaaacagctgtagcaatctgtcggagaatgacaaggctaaaggattatcttgaagctacaaagcaggggcagggaactaacaaagaccggttatgcattgatgtccttgagagagagatgagaaggaactccatgtctgagaacttggcaatgccatcagaggtgatggatgatgatttccaagcaaagctggactatctagaaaatacagtggcttttgtacggttgtttccttctgaagcgagagtagctatggaaatagcaggtgcagataccgccactggcctttcagcattaggtcagaaaggactaagtgggaacttaaaggagattgatttgaatgaaacgccctctatgcaagccaagagccgccaattgagactgctaactctgcttaaaacagtcgagacaggtcacctctacttccctcattgctcagaagtggttgttaagtttattgattgctactcccctcattgctcagaagtggttgatgagtttttggattgtgattggtccgatgcttccctcctagaaaagggtactcctgaagagcagatactcagaagggcatacttcatgaaacttaaagaagacatgcaggaggcactctgcaaggacgtggcttatcaccgtcattcagggctgccatcatcctgtgggacacgcaaacgt

SEQ ID NO: 890 - protein, 616 aa, Citrus clementina
  clementine0.9_005201m polypeptide
MENANEKSASLSFVSSYPTCWSTNQSTDTCDLDDLNMVLDGIMENANEKSASLSFVSSNPTCWSTNQSTDTCDLDDLNLRMQSSNPKETWHDAEIVVEGKSVAVNRSILSERSQFFRRLFNLRNDGSVSEGKPKYLLTDLVPHGKVGYEAFNDTLHYIYTGKTKAPPPEVSTCVDDACVHVSCPPTINYVIELMYASAALQMKKLVIRLELWLLNLVEKALVEDVIPILVAALHCQLNHLRSFCIQRIAKSNLDNVCLEKELPDEVSSEIKSLRVKSNQESEANIAEVDPMHAKIVRRIHKALDSDDVELLKLLLDVSNVTLDDAYALHYAAAYCSPKVFKEVLNMDLACLNLKDARGRTVLHVAARRNEPEVMVTLLSKGACASETTSDGQTAVAICRRMTRLKDYLEATKQGQGTNKDRLCIDVLEREMRRNSMSENLAMPSEVMDDDFQAKLDYLENTVAFVRLFPSEARVAMEIAGADTATGLSALGQKGLSGNLKEIDLNETPSMQAKSRQLRLLTLLKTVETGHLYFPHCSEVVVKFIDCYSPHCSEVVDEFLDCDWSDASLLEKGTPEEQILRRAYFMKLKEDMQEALCKDVAYHRHSGLPSSCGTRKR

SEQ ID NO: 891 - DNA, 1785 bp, Citrus clementina
  clementine0.9_005587m
atggttcttgatagtatcatggagaacgcaaacgaaatgtcatcatctttgagttttgcctcatcatcatatctctcaaatgggtcaactaatcacccagcaagtcctgaactttgctcgagtcttgataatttgagcttgagcaagctcagcagcaatcttgagaagctactgcttgatgctgagtatgactataccgatgccgagattgttgttgagggaaaatcagtggctcttcaccgctgcatattatctgcacgcagccaattttttcatgagctttttaaaaagggtaataataacgatggttctgctgtgagtgaggggaagccaaagtatctcatgactgaattggtgccttatggtaaagttggatatgaagctctcaatgttatcttgtattatttttacactgggaagcttaagccatctccttcggaagtctccacatgtgttgatgatgcttgtgctcatgatgcttgccctcctgctattaattatgctattgagttgatgtatgcttctgctgcttttcagatgaaagaactcgttttgctttttcagcgtcgccttctgaactttgttgagaaggcccttgtggaagatgtaattccaattcttgtggccgccttccattgccaactgaaccagctccgctctcactgtgtccagagagtagtaaggtcaaatcttgatgatgtctgtctcgagaaagagcttcctgatgaagtttcaggtgaaatcaaatcactccgtgtcaaatctgacgaggagtgtgaagctaatatagcagaagtggatcctatgcatgcaaaaagagtcagaagaatccacaaggcactggactctgatgacgttgaactgttgaagcttcttctggatgaatctaatgtcactttagatgatgcttacgctctgcactatgctgctgcctactgcaaccctaaggtttttaaggaagtgctcaatatgggcttggctgatctcaatcttaagaatgcaagaggtcatacagtgcttcatgtggctgcaaggcgtaaggagccagcagtgctggtgactctgctgagcaagggagcatgcgcatcagaaactacatcagatgggcaaacagctgtagcaatctgtcggagaatgacaaggcgaaaggattatattgaagctacaaagcaggggcaagaaactaacaaagaccggttatgcattgatgtccttgagagagaaatgagaaggaactccatgtctgggaacttggcactgtcatcagaggtgatggctgacgatttccaaatgaagctgaactatctggaaaatagagtggcttttgcgcggttgttgtttccttctgaagctagagtagctatgcatatagcagatgcagatgccaccaatttttatactggcctttcagcatcaaagtcaaaaggatcaagtgggaacttaaaggaggttgatttgaatgaaacaccctctatgcaagccaagagactccaattaagactgcaagctttgcttaaaacagttgagacgggccgacggtacttccctcattgctcagacgtggttgataagtttttggactgtgattggtctgatgcttccctcctagaaaatggtactcctgaagagcagagactcaaaagggcacgcttcatggaacttaaagaagacgtgcagaaggcattttacaaggatatggctgagaaaaatcgttcaggtttgtcgtcatcctcgtcgtcgtcatcttctccaaaggaaggagtaaagtgtaagggtaggaaaagg

SEQ ID NO: 892 - protein, 595 aa, Citrus clementina
  clementine0.9_005587m polypeptide
MVLDSIMENANEMSSSLSFASSSYLSNGSTNHPASPELCSSLDNLSLSKLSSNLEKLLLDAEYDYTDAEIVVEGKSVALHRCILSARSQFFHELFKKGNNNDGSAVSEGKPKYLMTELVPYGKVGYEALNVILYYFYTGKLKPSPSEVSTCVDDACAHDACPPAINYAIELMYASAAFQMKELVLLFQRRLLNFVEKALVEDVIPILVAAFHCQLNQLRSHCVQRVVRSNLDDVCLEKELPDEVSGEIKSLRVKSDEECEANIAEVDPMHAKRVRRIHKALDSDDVELLKLLLDESNVTLDDAYALHYAAAYCNPKVFKEVLNMGLADLNLKNARGHTVLHVAARRKEPAVLVTLLSKGACASETTSDGQTAVAICRRMTRRKDYIEATKQGQETNKDRLCIDVLEREMRRNSMSGNLALSSEVMADDFQMKLNYLENRVAFARLLFPSEARVAMHIADADATNFYTGLSASKSKGSSGNLKEVDLNETPSMQAKRLQLRLQALLKTVETGRRYFPHCSDVVDKFLDCDWSDASLLENGTPEEQRLKRARFMELKEDVQKAFYKDMAEKNRSGLSSSSSSSSSPKEGVKCKGRKR

SEQ ID NO: 893 - DNA, 1770 bp, Glycine max
  Glyma02g45260.1
atggataactcaaatgattcatcatcatccttgagttttgtatcatctcgcctttcacatggttctagtaatcacaacgtgtcttcctccaccagcaatgagcatggggcaaatattgaaattttgagtctgaataagctcagtggaagccttgagaagctattgattgagactgagtatgattatagtgatgctgagattcttgttgaagacatccctgtgggtattcatcgctgtatattggcgtcgcgtagtctgtttttccatgagctttttaagaaagggactgatggatcaggcaaggaaggaaagccaaggtatctcatgtcagatttggtgccttatggcacagttggatatgaagctttccaagtgttcttgtactatttgtatactggaaggttaaaggcttcaccaacagaagtgacaacatgtgtcgatgaaacatgtacccatgatgcatgccgccctgctatcaattatgccttagagctgatgtatgcttctgccacttttcagatgaaagagctggttttactttttcagcggcatctcctaaattttgttgagaaggctcttgtggaagatgtcattcctattcttatggctgctttcaactgccaactagaccagcttctctctcagtgcattcgtagagtagcaaggtctgactttgacaacacatctttggaaaaagagctccctcgtgaagttgtgactgaaatcaaattgctccgactcccatttcagccagaatccacacctaatgcaatggaagtggagtccttgaatgaaaagagtataaggagaatccacaaggcattggactctgatgatgttgagctactgaagcttcttctaaatgagtctagtgtcactctagatgatgcacatgccctgcactatgcttgtgcctatagcgattctaaggttattcaagaagttcttagtctaggcatggctgatattcttcgtagaaattcccgaggatacacagttcttcatgtggctgcaaggcgaaaggatccatccattttggtagcactactgaataaaggggcgtgtgcatcagataccactccagatggacaaactgctcttgcaatttgtcagaggttgacgagatacaaggattatcaagagcaaacagtccagtgtaaggaatctaacaaggacaggctctgtgttgatgtcctggagagggagatgagaagaaattctatgactgtgaatatgtctgtttcatcacagctaacagccaatgatttgcacatgagactggattaccttgaagatagagttgcatttgctcggctgttttttcctgctgaggctagggtagccattgagaatgctgaagcagattcatcgtcgatgtacgcaaactcatcggctttgaagggcacaaatggcaacctgaaacaagtagatctaaatgaatctccctctgctcataccagaaaacttcagttaagattacatgcccttatgaaaacagttgagaatggtaggcgcttctttccccattgctctgaagtgcttgataagtttctggaagatgacgatatgccagatgttttcttcctagagaagggcagtgaagacgagcagagaatcaagaaagcacgcttcatggaacttaaagatgatgtgcagaaggcatttcacaaggatatggctgaaaataaccattctggtttttcatctacggtgtcttcctcatcttcctcaactcgtagggaaggtcttaaccatagagtgaggagaaaa

SEQ ID NO: 894 - protein, 590 aa, Glycine max
  Glyma02g45260.1 polypeptide
MDNSNDSSSSLSFVSSRLSHGSSNHNVSSSTSNEHGANIEILSLNKLSGSLEKLLIETEYDYSDAEILVEDIPVGIHRCILASRSLFFHELFKKGTDGSGKEGKPRYLMSDLVPYGTVGYEAFQVFLYYLYTGRLKASPTEVTTCVDETCTHDACRPAINYALELMYASATFQMKELVLLFQRHLLNFVEKALVEDVIPILMAAFNCQLDQLLSQCIRRVARSDFDNTSLEKELPREVVTEIKLLRLPFQPESTPNAMEVESLNEKSIRRIHKALDSDDVELLKLLLNESSVTLDDAHALHYACAYSDSKVIQEVLSLGMADILRRNSRGYTVLHVAARRKDPSILVALLNKGACASDTTPDGQTALAICQRLTRYKDYQEQTVQCKESNKDRLCVDVLEREMRRNSMTVNMSVSSQLTANDLHMRLDYLEDRVAFARLFFPAEARVAIENAEADSSSMYANSSALKGTNGNLKQVDLNESPSAHTRKLQLRLHALMKTVENGRRFFPHCSEVLDKFLEDDDMPDVFFLEKGSEDEQRIKKARFMELKDDVQKAFHKDMAENNHSGFSSTVSSSSSSTRREGLNHRVRRK

SEQ ID NO: 895 - DNA, 1770 bp, Glycine max
  Glyma14g03510.1
atggataactcatatgattcatcctcatccttgagtttcgtatcatctcacctgtcacatggttctagtaatcacaacgtgtcttccaccaccagcaatgagcatggggaaaatattgaaattttgagtctgaataagctcagtggaagccttgagaagctattgattgaggttgagtatgattatagtgatgctgagattcttattgaggacatccctgtgggtattcatcgctgtatattggcatcgcgtagtccgttttttcatgagctttttaagaaagggactgatggatcagggaaggaaggaaagccaaggtatctcatgtcagatttgatgccttatggcacagttggatatcaagctttccaagtgttcttgtactatctgtatactggaaggctaaaggcttcaccaacagaagagacaacatgtgttgatgaaacatgtatccatgtagcatgccgccctgctatcaatcatgccctagagctgatgtatgcttctgccacttttcagatgaaagagctagttttactttttcagcggcatctcctaaattttgttgagaaggctcttgtggaagatgtcattcctattcttatggctgctttcaactgccaactagaccagcttctctctcggtgcattcagagagtagcaaggtctgactttgacaacacatctttggaaaaagagctccctcatgaagttttgactgaaatcaaatcactccgactctcatttcagccagaatccacacctaatgcaatggaagcggagtccttgaatgaaaagagtatcaggagaatccacaaggcattggactctgatgatgttgagctactgaagcttcttctaaatgagtctagtgtcactctagatgatgcatatgccctgcactatgcttgtgcctatagcgattctaaggttattcaagaagttcttagtctaggcatggctgatattcttcgtagaaattcccgaggatacacagttctccatgtggctgcaaggcgaaaggatccatccattttggtagcactactgaataaaggggcacgtgcatcagataccactccagatggacaaaccgctcttgcaatttgtcagaggttgacaagatgcaaggattatcatgagaaaacagtgcagtgtaaggaatctaacaaggacaggctttgtgttgatgtcctggagagggagatgagaagaaattctatgactgtgaatatgtctgtttcatcacagttaacagctgatgatttgcacatgagactggattaccttgaagatagagttgcatttgctcggctgttgtttcctgctgaggctagggtagccattgagaatgctgaagcagattcatcatcactgtatgcaaattcatcggctttgaaggtcacaaatggcaacccgaaagaagtagatctaaatgaatctccctcggctcgaaccagaaaactccagttaagattgcatgcccttatgaaaacagttgagaatggtaggcgcttctttccccattgctctgaagtgcttgataagtttctggaagacgacgaaatgccagatgttttcttcctagagaagggcagtgaagaagagcagagaatcaaaaaagcacgcttcatggagcttaaagatgatgtgcaaaaggcatttcacaaggatatggctgaaaataaccattctggtttttcatctacggtgtcttcctcttcttcctcaactcgtagggaaggtcttaaccatagagtaaggagaaaa

SEQ ID NO: 896 - protein, 590 aa, Glycine max
  Glyma14g03510.1 polypeptide
MDNSYDSSSSLSFVSSHLSHGSSNHNVSSTTSNEHGENIEILSLNKLSGSLEKLLIEVEYDYSDAEILIEDIPVGIHRCILASRSPFFHELFKKGTDGSGKEGKPRYLMSDLMPYGTVGYQAFQVFLYYLYTGRLKASPTEETTCVDETCIHVACRPAINHALELMYASATFQMKELVLLFQRHLLNFVEKALVEDVIPILMAAFNCQLDQLLSRCIQRVARSDFDNTSLEKELPHEVLTEIKSLRLSFQPESTPNAMEAESLNEKSIRRIHKALDSDDVELLKLLLNESSVTLDDAYALHYACAYSDSKVIQEVLSLGMADILRRNSRGYTVLHVAARRKDPSILVALLNKGARASDTTPDGQTALAICQRLTRCKDYHEKTVQCKESNKDRLCVDVLEREMRRNSMTVNMSVSSQLTADDLHMRLDYLEDRVAFARLLFPAEARVAIENAEADSSSLYANSSALKVTNGNPKEVDLNESPSARTRKLQLRLHALMKTVENGRRFFPHCSEVLDKFLEDDEMPDVFFLEKGSEEEQRIKKARFMELKDDVQKAFHKDMAENNHSGFSSTVSSSSSSTRREGLNHRVRRK

SEQ ID NO: 897 - DNA, 1521 bp, Glycine max
  Glyma02g45260.2
atggataactcaaatgattcatcatcatccttgagttttgtatcatctcgcctttcacatggttctagtaatcacaacgtgtcttcctccaccagcaatgagcatggggcaaatattgaaattttgagtctgaataagctcagtggaagccttgagaagctattgattgagactgagtatgattatagtgatgctgagattcttgttgaagacatccctgtgggtattcatcgctgtatattggcgtcgcgtagtctgtttttccatgagctttttaagaaagggactgatggatcaggcaaggaaggaaagccaaggtatctcatgtcagatttggtgccttatggcacagttggatatgaagctttccaagtgttcttgtactatttgtatactggaaggttaaaggcttcaccaacagaagtgacaacatgtgtcgatgaaacatgtacccatgatgcatgccgccctgctatcaattatgccttagagctgatgtatgcttctgccacttttcagatgaaagagctggttttactttttcagcggcatctcctaaattttgttgagaaggctcttgtggaagatgtcattcctattcttatggctgctttcaactgccaactagaccagcttctctctcagtgcattcgtagagtagcaaggtctgactttgacaacacatctttggaaaaagagctccctcgtgaagttgtgactgaaatcaaattgctccgactcccatttcagccagaatccacacctaatgcaatggaagtggagtccttgaatgaaaagagtataaggagaatccacaaggcattggactctgatgatgttgagctactgaagcttcttctaaatgagtctagtgtcactctagatgatgcacatgccctgcactatgcttgtgcctatagcgattctaaggttattcaagaagttcttagtctaggcatggctgatattcttcgtagaaattcccgaggatacacagttcttcatgtggctgcaaggcgaaaggatccatccattttggtagcactactgaataaaggggcgtgtgcatcagataccactccagatggacaaactgctcttgcaatttgtcagaggttgacgagatacaaggattatcaagagcaaacagtccagtgtaaggaatctaacaaggacaggctctgtgttgatgtcctggagagggagatgagaagaaattctatgactgtgaatatgtctgtttcatcacagctaacagccaatgatttgcacatgagactggattaccttgaagatagagttgcatttgctcggctgttttttcctgctgaggctagggtagccattgagaatgctgaagcagattcatcgtcgatgtacgcaaactcatcggctttgaagggcacaaatggcaacctgaaacaagtagatctaaatgaatctccctctgctcataccagaaaacttcagttaagattacatgcccttatgaaaacaggtatgtccaagacaattttgaaa

SEQ ID NO: 898 - protein, 507 aa, Glycine max
  Glyma02g45260.2 polypeptide
MDNSNDSSSSLSFVSSRLSHGSSNHNVSSSTSNEHGANIEILSLNKLSGSLEKLLIETEYDYSDAEILVEDIPVGIHRCILASRSLFFHELFKKGTDGSGKEGKPRYLMSDLVPYGTVGYEAFQVFLYYLYTGRLKASPTEVTTCVDETCTHDACRPAINYALELMYASATFQMKELVLLFQRHLLNFVEKALVEDVIPILMAAFNCQLDQLLSQCIRRVARSDFDNTSLEKELPREVVTEIKLLRLPFQPESTPNAMEVESLNEKSIRRIHKALDSDDVELLKLLLNESSVTLDDAHALHYACAYSDSKVIQEVLSLGMADILRRNSRGYTVLHVAARRKDPSILVALLNKGACASDTTPDGQTALAICQRLTRYKDYQEQTVQCKESNKDRLCVDVLEREMRRNSMTVNMSVSSQLTANDLHMRLDYLEDRVAFARLFFPAEARVAIENAEADSSSMYANSSALKGTNGNLKQVDLNESPSAHTRKLQLRLHALMKTGMSKTILK

SEQ ID NO: 899 - DNA, 1722 bp, Eucalyptus grandis
  Eucgr.A02033.1
atggaatatgagaatggactgtcttcgccgtcgtcttacttgtcgaacgggtctacagatcacgacgcggcggttcccgtcatgaatccggagtcgggctataaccctgatcttctgagcttgaccaagctcagcgatagtctcgacaagctgctgtgtgatgacgattacggctacactgacgcggtgatagtggtcgagggcgtccctgtgggagtccacaggtgcttgttggcggctcggagccagtttcttcacgagtttttcaagcagggaggcggcgacaatgcaagggaaggaaagccgaggtatcccatttcggacttagtgaaaaagggtcatgttggatgtgaggcttttaaatatgtgttgagatacatgtacacggggaagctcaagctatttccagcggaggtgtcgacatgcgtggacagcagttgcgcacatgacgtgtgcggccctgctattaattatgccgtggagttgatgtatgcctcggccacttttgagatagcagagttagtgatgcttgttcagcgtcgtcttttacactttattgggaaggccgcggttgaagatgttatccccatacttaaggttgctttcaacttccggttgaaggagcttctcccatcctgcttcgaaacagtcgccagatcttatatggacagtattgtgttagaaaaggagcttcctcacgagatttatgctgaaataaaagtgcaacgtgacagatttggcgaggctggtgaaccaatggtaaccgaagtgaatccctcgctggaaaagagtatcaagcagatccacaaagctttggacaatgatgacgtcgaattggtcaggcgtctcctaaatgaatcggttgtcactctagatgatgcttatgctcttcactatgccactgcttactgtcatcccaagattttcaaggaggtgcttggtctaggattggcagaccttaacctcaaggactctcggggatacacagtacttcatgtggctgcaaggcgaaaggcaccgtctattttattgcctctgctgtataagggtgcctgtgcaatggaaagcacatcagatggtcaaacagctgttacaatttgtcggagatcgacgaggcccaaggattatttccaggagacaaaacaagggcaggaatctaacaaagaccgaatatgcattgatgcccttgaaagggagatgcaacgtcgtatttcggaggctgggtacatgtcgatatcaccagatgcaataactgatgacatttacaggcttgactacctggttggcagagtaaaatttgcagcgatgttttttcctgctgaagccaagatagctatggagattgcagatgcagagtggacctcattgtataaaggtttagcatcaaaaagcttgaatgtagacttcaaggaggttgatttgaacgaaggccctgctttccttgcaaacggacttcaagcactgcgtaaaacagtggaaatgggccgccgctatttccctcattgctcagaagttctagacaaatttctggacgaggctcccgatgatttcttccttgatcagggcacatctgaagagaagacaagtaaaaagatgcgtttcatggaacttaaggaagagttccagaaggccattagcaaggacatggcagagaacaagaaatcaggtcggtttcctgcctcgtcatcctcatgttctccaagacaaaggatgaagaaaaag

SEQ ID NO: 900 - protein, 574 aa, Eucalyptus grandis
  Eucgr.A02033.1 polypeptide
MEYENGLSSPSSYLSNGSTDHDAAVPVMNPESGYNPDLLSLTKLSDSLDKLLCDDDYGYTDAVIVVEGVPVGVHRCLLAARSQFLHEFFKQGGGDNAREGKPRYPISDLVKKGHVGCEAFKYVLRYMYTGKLKLFPAEVSTCVDSSCAHDVCGPAINYAVELMYASATFEIAELVMLVQRRLLHFIGKAAVEDVIPILKVAFNFRLKELLPSCFETVARSYMDSIVLEKELPHEIYAEIKVQRDRFGEAGEPMVTEVNPSLEKSIKQIHKALDNDDVELVRRLLNESVVTLDDAYALHYATAYCHPKIFKEVLGLGLADLNLKDSRGYTVLHVAARRKAPSILLPLLYKGACAMESTSDGQTAVTICRRSTRPKDYFQETKQGQESNKDRICIDALEREMQRRISEAGYMSISPDAITDDIYRLDYLVGRVKFAAMFFPAEAKIAMEIADAEWTSLYKGLASKSLNVDFKEVDLNEGPAFLANGLQALRKTVEMGRRYFPHCSEVLDKFLDEAPDDFFLDQGTSEEKTSKKMRFMELKEEFQKAISKDMAENKKSGRFPASSSSCSPRQRMKKK

SEQ ID NO: 901 - DNA, 1446 bp, Eucalyptus grandis
  Eucgr.A02033.2
atggaatatgagaatggactgtcttcgccgtcgtcttacttgtcgaacgggtctacagatcacgacgcggcggttcccgtcatgaatccggagtcgggctataaccctgatcttctgagcttgaccaagctcagcgatagtctcgacaagctgctgtgtgatgacgattacggctacactgacgcggtgatagtggtcgagggcgtccctgtgggagtccacaggtgcttgttggcggctcggagccagtttcttcacgagtttttcaagcagggaggcggcgacaatgcaagggaaggaaagccgaggtatcccatttcggacttagtgaaaaagggtcatgttggatgtgaggcttttaaatatgtgttgagatacatgtacacggggaagctcaagctatttccagcggaggtgtcgacatgcgtggacagcagttgcgcacatgacgtgtgcggccctgctattaattatgccgtggagttgatgtatgcctcggccacttttgagatagcagagttagtgatgcttgttcagcgtcgtcttttacactttattgggaaggccgcggttgaagatgttatccccatacttaaggttgctttcaacttccggttgaaggagcttctcccatcctgcttcgaaacagtcgccagatcttatatggacagtattgtgttagaaaaggagcttcctcacgagatttatgctgaaataaaagtgcaacgtgacagatttggcgaggctggtgaaccaatggtaaccgaagtgaatccctcgctggaaaagagtatcaagcagatccacaaagctttggacaatgatgacgtcgaattggtcaggcgtctcctaaatgaatcggttgtcactctagatgatgcttatgctcttcactatgccactgcttactgtcatcccaagattttcaaggaggtgcttggtctaggattggcagaccttaacctcaaggactctcggggatacacagtacttcatgtggctgcaaggcgaaaggcaccgtctattttattgcctctgctgtataagggtgcctgtgcaatggaaagcacatcagatggtcaaacagctgttacaatttgtcggagatcgacgaggcccaaggattatttccaggagacaaaacaagggcaggaatctaacaaagaccgaatatgcattgatgcccttgaaagggagatgcaacgtcgtatttcggaggctgggtacatgtcgatatcaccagatgcaataactgatgacatttacaggcttgactacctggttggcagaggtaaacccaagtgcagaatcgtttgctatgtcttttctttagttgatctttatttctttggcaagatttgctttccttttttggatgttgaggaacctcaccttatgcgggtaaatattaggtgcataagatgcgcccataacttcatgaaagaa

SEQ ID NO: 902 - protein, 482 aa, Eucalyptus grandis
  Eucgr.A02033.2 polypeptide
MEYENGLSSPSSYLSNGSTDHDAAVPVMNPESGYNPDLLSLTKLSDSLDKLLCDDDYGYTDAVIVVEGVPVGVHRCLLAARSQFLHEFFKQGGGDNAREGKPRYPISDLVKKGHVGCEAFKYVLRYMYTGKLKLFPAEVSTCVDSSCAHDVCGPAINYAVELMYASATFEIAELVMLVQRRLLHFIGKAAVEDVIPILKVAFNFRLKELLPSCFETVARSYMDSIVLEKELPHEIYAEIKVQRDRFGEAGEPMVTEVNPSLEKSIKQIHKALDNDDVELVRRLLNESVVTLDDAYALHYATAYCHPKIFKEVLGLGLADLNLKDSRGYTVLHVAARRKAPSILLPLLYKGACAMESTSDGQTAVTICRRSTRPKDYFQETKQGQESNKDRICIDALEREMQRRISEAGYMSISPDAITDDIYRLDYLVGRGKPKCRIVCYVFSLVDLYFFGKICFPFLDVEEPHLMRVNIRCIRCAHNFMKE

SEQ ID NO: 903 - DNA, 1302 bp, Populus trichocarpa
  POPTR_0002s05740.1
atggaaagtgccaatgaaatgacatcttctttgagtttcgcttcatcttcgtacttatcaaatgggtctagtatccaccacgtatcagcctcaaatgttcctgagcctggtgtaaaccttgaaaacttgagcttaaacaagcttagtggcaatcttgaaaggctattacttgataaggagtatgattacagcgatgcagagatttttgtcgagggcacccctgttggtgtccatcggtgtgtattggctgcccgtagtcagttctttcatgagctttttaagaagggaaataacaattcgacgaatggagataaacccaggtacctcatgtctgatttggtgccttatggtggggttggatatgaagcctttcatgttttcttgcattatttgtacactggaaagcttaagccatctccgccagaagtgtcacgatgtgttgatgatgcttgtgcccatgatgtttgccgccctgctattaattatgtagtggaattgatgtgtgcctctgccacttttcagatgaaagagcttgttttgctttttcagcggcgtctcctgaactttattgagaaggctcttgttgaagatgtaatcccaattcttatggctgctttccactaccagctagaccagctcctctctcactgcatcgaaagacttgtaagatcagatcttgatagcacatgcatagataaagagctccctgatgaaatttcaagtaaaattaaattacttcgcaaaaaatctctgccagaagctgaaagtagtgttgaagaggtggaccccatacttgaaaagagtttcaggagaatccacaaggcattggattcagacgatgttgaactggtggagcttctcttgagtgaatctaatttaactttggatgatgcttatgctctccattatgctgttgcctactgtgatcctaagatcgtcaaggaagttcttagtttaggctcggctgatctcaatctcaggaactccagaggatattcagtgcttcatgttgctgcaaggcgcaaggagccatcaatcataatggcactactaactaggggcgccagtgcatcagaaactacattggatggacaaaatgcagttgcaatttgtcgtaggttgactaggccaaaggattataatgaaaacaccaagcaaggtcaggaatctaacaaagacaggatatgcattgatgtactggagacagatatgcgaagaaggaattcaatgtctgcaaacgtctcaacactgtcgccatcggtagctgatgatttgagcatgaagctggactacctggaaaat

SEQ ID NO: 904 - protein, 435 aa, Populus trichocarpa
  POPTR_0002s05740.1 polypeptide
MESANEMTSSLSFASSSYLSNGSSIHHVSASNVPEPGVNLENLSLNKLSGNLERLLLDKEYDYSDAEIFVEGTPVGVHRCVLAARSQFFHELFKKGNNNSTNGDKPRYLMSDLVPYGGVGYEAFHVFLHYLYTGKLKPSPPEVSRCVDDACAHDVCRPAINYVVELMCASATFQMKELVLLFQRRLLNFIEKALVEDVIPILMAAFHYQLDQLLSHCIERLVRSDLDSTCIDKELPDEISSKIKLLRKKSLPEAESSVEEVDPILEKSFRRIHKALDSDDVELVELLLSESNLTLDDAYALHYAVAYCDPKIVKEVLSLGSADLNLRNSRGYSVLHVAARRKEPSIIMALLTRGASASETTLDGQNAVAICRRLTRPKDYNENTKQGQESNKDRICIDVLETDMRRRNSMSANVSTLSPSVADDLSMKLDYLENR

SEQ ID NO: 905 - DNA, 1758 bp, Populus trichocarpa
  POPTR_0005s22770.1
atggaaaatgccattgaaacgacatcttcttttagttttgattcatcttcttatttatcaaaagggcctagcagccaccgcgtaccaatcccagatgttcccgagcctggtgtaagccttgaaaactttagcttaagcaagcttagtggtaatctggaaaggctattacttgatggggaatatgattacagcgatgcagaaattgttgttgagggcatccctgtaggtgtccataggtgtatattggctgctcgtagtcagttctttcatgagctttttaagaaggtagatagtaattcgacaagcggagataaaccaaggtacctcatgtctgatttgatgccttatggtggggttggatatgaagcctttaatgtttttttacattatttgtataccggaaagcacaagtcgtctccgccagaagtgtcacaatgtgtttacgacgcttgtgcccatgatgcttgccgccctgctattaattatgcagtggaattgatgtatgcctctgccacttttcagatgaaagagcttgttttgctttttcagcggcgtctcctgagttttatcgacaaggctcttgatgaagatgtaatcccaattgttatggctgccttccactgccagctagaccagcttctctctctctgcatcgaaagacttgtaaggtcagatcttgatagtgtatgcatcgacaaggagctccctcatgaaatttcaagtaaggttaaattactgcgcaaaaaatctctggaagaagctgaaagtagcgttgaagaggtagaccccatgcgtgaaaagagaatgagtagaatccacaaggctttggagtcagatgatgttgaactggtgcagcttctcttgagtgaatctaattttacgttggatgatgcttatgctctccattacgctgtttcctactgcgatcctaaggttgtcaaggaagttcttgctttaggcttggctgatctcaatcttaggaactccaggggatatacagtacttcacgtggctgcaaggcgcaaggagtcatcaatccttgtggcactactagctaagggtgcccgtgcatcagaaattacaatggatggacgaaatgcagtttcaatctggcgtagtttgactaggccaaaggattataatgcaaacaccaagcaaggccaggaatctaacaaagacaggatatgcattgaaatcttggagacagagatgcgtaggacttcaatgtctgcaaacatatcgatgatatcgccagatttgaacatgaagccggacgacctggaagatagagtggcgtttgcacgattgttttttcctgctgaggcccggctagctaaggacatggcaaatgcagattcaacctcaatgtacactggccttccagcgtcaaaatcaaaaggctcaagtggggacacaagggaggttgatttgaacgagacaccttctgttcaagacaaaagactccagttgagactacaagaactgcgtaaaacagtggagatgggacggctctatttcccgcattgctcagaagttcttgacaagtttctggatgacgatgtgcctgatgctctctacctagataagggtactcctgcagagcagaaaaccaagaagatgcgcttcctggaacttaaagaggatgtacagatggcatttaacaaggacatggagaaaaatagatcagtcctctcatcatcttcttcgttctcatcttctccaaaaagtggtgtaacacgcaaggctaggaggaagtgc

SEQ ID NO: 906 - protein, 586 aa, Populus trichocarpa
  POPTR_0005s22770.1 polypeptide
MENAIETTSSFSFDSSSYLSKGPSSHRVPIPDVPEPGVSLENFSLSKLSGNLERLLLDGEYDYSDAEIVVEGIPVGVHRCILAARSQFFHELFKKVDSNSTSGDKPRYLMSDLMPYGGVGYEAFNVFLHYLYTGKHKSSPPEVSQCVYDACAHDACRPAINYAVELMYASATFQMKELVLLFQRRLLSFIDKALDEDVIPIVMAAFHCQLDQLLSLCIERLVRSDLDSVCIDKELPHEISSKVKLLRKKSLEEAESSVEEVDPMREKRMSRIHKALESDDVELVQLLLSESNFTLDDAYALHYAVSYCDPKVVKEVLALGLADLNLRNSRGYTVLHVAARRKESSILVALLAKGARASEITMDGRNAVSIWRSLTRPKDYNANTKQGQESNKDRICIEILETEMRRTSMSANISMISPDLNMKPDDLEDRVAFARLFFPAEARLAKDMANADSTSMYTGLPASKSKGSSGDTREVDLNETPSVQDKRLQLRLQELRKTVEMGRLYFPHCSEVLDKFLDDDVPDALYLDKGTPAEQKTKKMRFLELKEDVQMAFNKDMEKNRSVLSSSSSFSSSPKSGVTRKARRKC

SEQ ID NO: 907 - DNA, 1761 bp, Populus trichocarpa
  POPTR_0015s15800.1
atggctaatttctctgagccatcgtcatctctgagctatacttcatcttctcatttatcaaatggctcaattagtcacaacatatccaactcctcaggtgctgaggcgggaactagtcttgaggtgattagtctaaacaagctgagctctaatttggagcagctattaattgactccacttgtgattatagtgatgctgatattgttgttgagggtaccgctattggcgttcaccgatgtattttaggtgctaggagtaagtttttccacgagttgtttaggagagaaaagggatcttcagagaaagaaggaaaaccaaagtattgcatgagtgatttgttaccttgtggaaaggttggatatgaagccttcctaattttcttgagctatttgtatactggaaaactcaagccatctccaatggaagtctcaacatgtgttgacaatgtatgtgcccatgatgcgtgtagacctgcaattaattttgcagtggaattgatgtatgcatcatccatatttcaagtaccagagctggtttcacttttccagagacgccttcagaactttgttgggaaagctcttgtggaagatatgattccaatccttgtggttgccttccattgccaattaagtcagcttgtcacacaatgtgttgatagaatagcacggtctgatcttgacaacatctctatagagaaggagcttccccatgatgttgcagttgaaattaaactgctccgacgcaagtctatttctgatgaagaaaacaacacagaggctgtggatgccctgcgtgaaaagagaatcaagaggatacacatggcattagactcagatgatgttgaacttgtgaaacttctcctgactgaatctgatataaccttagatgatgctaacgctctccattatgctgcatcgtactgtgatctcaaggtcgtgtctgaggtgcttagcctcggtcttgctgacgtcaatcttagaaattcacgaggttacacagttctccacattgctgcaatgcgaaaagaaccatcagtgatagtgtcaatgctggcgaaaggagcatctgctttggacttgacatcagatgggcaaagtgctgttagtatttgtcgaaggttgacaaggccaaaagactatcatgctaaaacagagcaagggcaggaagcgaacaaggacaggttatgcattgatatcttagagagggaaatgagaaggaatccaatggctgggagtgcctccatcacttcccatacaatggttgatgatctgcacatgaagctgctatacctggagaacagagtggcatttgcaagattatttttccctactgaagccaagctagccatggacattgcacatgctgcaacaacaccagaatttgctggtcttgctgcatcaaaaggttctaacgggaatttgagggaggttgacctaaatgagacaccaataatgcagaacaaaagacttcgttctaggatggaagcccttatgaaaacagttgaaatgggccgacgatacttccccagttgctctgaagtgctcgataagttcatggaggatgaccttcctgatttgttttaccttgaaaagggtaccccagatgaacaaagaatcaagaggacacgtttcatggagcttaaagaggatgttcacagggcatttaccaaggacaaggctgagattaaccgcactggtttgtcttcctcgtcatcctcatcttctctaaaagatggtattagtaacaaactcaggaaatta

SEQ ID NO: 908 - protein, 587 aa, Populus trichocarpa
  POPTR_0015s15800.1 polypeptide
MANFSEPSSSLSYTSSSHLSNGSISHNISNSSGAEAGTSLEVISLNKLSSNLEQLLIDSTCDYSDADIVVEGTAIGVHRCILGARSKFFHELFRREKGSSEKEGKPKYCMSDLLPCGKVGYEAFLIFLSYLYTGKLKPSPMEVSTCVDNVCAHDACRPAINFAVELMYASSIFQVPELVSLFQRRLQNFVGKALVEDMIPILVVAFHCQLSQLVTQCVDRIARSDLDNISIEKELPHDVAVEIKLLRRKSISDEENNTEAVDALREKRIKRIHMALDSDDVELVKLLLTESDITLDDANALHYAASYCDLKVVSEVLSLGLADVNLRNSRGYTVLHIAAMRKEPSVIVSMLAKGASALDLTSDGQSAVSICRRLTRPKDYHAKTEQGQEANKDRLCIDILEREMRRNPMAGSASITSHTMVDDLHMKLLYLENRVAFARLFFPTEAKLAMDIAHAATTPEFAGLAASKGSNGNLREVDLNETPIMQNKRLRSRMEALMKTVEMGRRYFPSCSEVLDKFMEDDLPDLFYLEKGTPDEQRIKRTRFMELKEDVHRAFTKDKAEINRTGLSSSSSSSSLKDGISNKLRKL

SEQ ID NO: 909 - DNA, 1743 bp, Solanum lycopersicum
  Solyc02g069310.2.1
atggcaagttctgctgaaccatcatcttctataagctttacttcaacttccaacacgtcgaatgggtccattggcataggccaaaacacatgtgcctgtggtggatctgagacagggagtagttatgaaatcatcagcttaagtaaactcagtaataatttagagcaactattgttagattccagctctgagtttagtgatgctgagattgttgttgagggtgtttcactcggtgttcatcgttgtatattagctgcgaggagtagtttttttagggatctttttaggaaaagaaacggaaattgtggaaaggaaggtaagccaagttactctatgattgatatattgccttgtggtaaggttggatatgaggctttccttactttcttaagctatttgtactcgggaaaattgaagcatttccctccagaggcatcaacgtgtgtcaacagtttatgttcccatgactcttgcagaccagcaatcaactttcatgttgagttgatgtatgcctcttttgtctttcaggttccagagctggtgtcactttttctgcgacacctattcagttttgttggcaaggctcttgtggaagatgttatcccaatacttggagttgctttccattgccaaatgagtgagcttctcactcattgcgttgatagagtagcgcgatcagatcttgaaagcacatgtattgagaaggaggttccctttaaagttgcagagagtattaagttatcgcggctgaaatgtcagggtgatgaaagtatggttctaaccgtggatccgttgcatgaaaagagaaaaaataggatatacaaggcattggattcggatgatgttgaacttgtcaagcttttacttaatgagtctgacataagtttagatggagcctacgctcttcattatgctgttgcatattgtgaccccaaggttgttgctgaggttcttggactgggtgttgctaatgtcaaccttcggaatgcacgtggttacactgtgcttcacattgctgccatgcgtaaggaaccctcaatcattgtatcacttttaactaagggagctcatgcatcagaaattacattggatgggcagagtgctgttagtctctgtaggaggctgactaggcctaaggagtaccatgcaaaaacagaacaagggcaggaagcaaacaaagatcgggtatgtattgatgttttggagagagagatgcgtcgcaacccaatgactggagatgcattattttcttcccccatgttggccgatgatctgccgatgaaactgctctacctggaaaacagagtggcatttgcacgattattgttccctcttgaagccaaactagccatggaaattgcaactgctgaaacaacagctgaattcgcggatcatttggcatctaaagcttcatctggaattttgagggaggttgatctgaatgagacacccataatgcagaaagaaagactctcgaagacagttgagctgggcaaatgctactttcctcattgctccgaagttctggataagtttatggaggatgacttaccagacttatttttccttgaaaagggcactccagaggaacaaaagatcaagcggaggcgatttaaggagctcaaagatgatgttcaaagggcatttaataaagacaaggctggacttcaccgctctggctcgtcttcctcatcatcttccacaacttttaacgacggtgcaagtgtcaaagctaggaaccta

SEQ ID NO: 910 - protein, 581 aa, Solanum lycopersicum
  Solyc02g069310.2.1 polypeptide
MASSAEPSSSISFTSTSNTSNGSIGIGQNTCACGGSETGSSYEIISLSKLSNNLEQLLLDSSSEFSDAEIVVEGVSLGVHRCILAARSSFFRDLFRKRNGNCGKEGKPSYSMIDILPCGKVGYEAFLTFLSYLYSGKLKHFPPEASTCVNSLCSHDSCRPAINFHVELMYASFVFQVPELVSLFLRHLFSFVGKALVEDVIPILGVAFHCQMSELLTHCVDRVARSDLESTCIEKEVPFKVAESIKLSRLKCQGDESMVLTVDPLHEKRKNRIYKALDSDDVELVKLLLNESDISLDGAYALHYAVAYCDPKVVAEVLGLGVANVNLRNARGYTVLHIAAMRKEPSIIVSLLTKGAHASEITLDGQSAVSLCRRLTRPKEYHAKTEQGQEANKDRVCIDVLEREMRRNPMTGDALFSSPMLADDLPMKLLYLENRVAFARLLFPLEAKLAMEIATAETTAEFADHLASKASSGILREVDLNETPIMQKERLSKTVELGKCYFPHCSEVLDKFMEDDLPDLFFLEKGTPEEQKIKRRRFKELKDDVQRAFNKDKAGLHRSGSSSSSSSTTFNDGASVKARNL

SEQ ID NO: 911 - DNA, 1224 bp, Glycine max
  Glyma15g13320.2
atgagacgtctacttaactttatagggaaggctcttgtggaagatgtcatcccaatcctcactgttgctttccattgtcaattgagtcaacttgtcaatcaatgcattgatagggtggccagatcagaccttgaccagatttcaattgaccaagagcttccaaatgaactctcacaaaaagttaaattgctccgccgcaaccctcagcgagatgttgaaaacgatgcttctatagtggatgctttgtctctaaaaagaatcactagaatacacaaggcattggattcagatgatgttgagcttgttaaacttcttttaaatgaatcagacattactttagatgaagccaatgctctccattatgctgcagcctactgtgatcccaaggttgtttctgaggtacttggtttgggactcgctaatgtcaatcttcgaaattctagggggtacacagtgcttcacattgctgccatgcgtaaagagccttccattatagtatccctacttacgaaaggggcttgtgcatcagatttgacttttgatggtcagagtgctgttagtatttgtaggaggttgacaaggccaaaggattatcatgcaaaaacagagcaggggaaagaaacaaacaaagatcggatatgcatcgatgttcttgaaagagaaatgtggaggaatccattggctggggatgcctgtatgtcttcccataccatggctgatgatctccacatgaaactactataccttgagaacagagtggcatttgcaagacttttcttcccttcagaagccaaactagccatggacattgcacatgctgagacaacatctgagtttgctggtctttctgcatcaaactcaaaaggttcaaatggaaacttaagggaggttgatctcaatgaaactcctatagttcaaagtaaaagacttttttctagaatggaagcccttatgaaaacagtggagatggggcggcgctacttcccgcattgctcggaagtgttggataagttcatggaggatgacttgcctgacttgttttaccttgaaaagggtactaatgaagagcagagaatcaaaaggacacgtttcatggagcttaaagatgacgtccacaaggctttcaacatggacaaggccgagtttagccgctctgggatttcatcttcatcatcctcatcatccctcagagattctgttgtacattacaaggctaggaaagtg

SEQ ID NO: 912 - protein, 408 aa, Glycine max
  Glyma15g13320.2 polypeptide
MRRLLNFIGKALVEDVIPILTVAFHCQLSQLVNQCIDRVARSDLDQISIDQELPNELSQKVKLLRRNPQRDVENDASIVDALSLKRITRIHKALDSDDVELVKLLLNESDITLDEANALHYAAAYCDPKVVSEVLGLGLANVNLRNSRGYTVLHIAAMRKEPSIIVSLLTKGACASDLTFDGQSAVSICRRLTRPKDYHAKTEQGKETNKDRICIDVLEREMWRNPLAGDACMSSHTMADDLHMKLLYLENRVAFARLFFPSEAKLAMDIAHAETTSEFAGLSASNSKGSNGNLREVDLNETPIVQSKRLFSRMEALMKTVEMGRRYFPHCSEVLDKFMEDDLPDLFYLEKGTNEEQRIKRTRFMELKDDVHKAFNMDKAEFSRSGISSSSSSSSLRDSVVHYKARKV

SEQ ID NO: 913 - DNA, 1263 bp, Vitis vinifera
  GSVIVT01026274001
atgtatgcctctgctatttttcaggtaccagagctggtctcactttttcagcggcgtcttaccaacttcatcggaaaggctcttttagaagatgttatcccaatccttgtagttgcctaccattgtaaatcaagtgttcttgtcaaccaatgtgttgacagagtagccagatcagatcttgacagcatttctcttgagaaagatctcccttatgaggttgcagagagcattaaattgctccgcctcaagtctcagcctgatgatgaatgtaacactgtacctgtggaccctgtgcatgaaaaaagagtcaggagaatactcaaggcattggactcagatgatgttgaactcgtgaaacttcttctaagtgagtctggtataaccttggatgaagcatatgccctccattatgctgcagcatactgtgatcccaaggttgtctctgaagtgcttagtctgggtctggctgatgtcaaccgtcataatcctcgaggttacactgttctccatgtggctgcaatgcgtaaggagccatcaataattgtttcacttctgacaaaaggggctcatgcatcagaaaggacttcagatgggcaaagtgctgttagtatctgccgcaggttaacaaggccgaaggattatcatgcaaaaatggaacaggggcaggaaacaaacaaggacaggatatgcattgatgttctggagagagaaatgcggaggaatccactggctggagatgtgtcaatctcttcaccaacaatggctgatgatctgcacatgaagttgctgtacctggaaaatagagtggcatttgcacgattattcttccctagtgaagcaaagctagccatggagatagcgcatgctgagacaacctccgagtttgctggcctttctgcatcaaaaagatctagtgggaacctaagggaggttgatttgaatgagacacccataatgcagaaccagaggcttcgttcaaggatgaatgcccttgtgaaaacagtggagatgggtcgacgctacttcccacattgctcacaagtcctggataagttcatggaggacgaccttcctgatttgttctaccttgagaagggcactctggatgaacagaggattaagaggacgcgtttcatggagcttaaagaggatgttcaacgagcatttacgaaagacaaggctgagttcaatcgctctgggttatcttcatcttcatcttcatcctccctaaaagacaatttaagtcacaaggctagaaaatta

SEQ ID NO: 914 - protein, 421 aa, Vitis vinifera
  GSVIVT01026274001 polypeptide
MYASAIFQVPELVSLFQRRLTNFIGKALLEDVIPILVVAYHCKSSVLVNQCVDRVARSDLDSISLEKDLPYEVAESIKLLRLKSQPDDECNTVPVDPVHEKRVRRILKALDSDDVELVKLLLSESGITLDEAYALHYAAAYCDPKVVSEVLSLGLADVNRHNPRGYTVLHVAAMRKEPSIIVSLLTKGAHASERTSDGQSAVSICRRLTRPKDYHAKMEQGQETNKDRICIDVLEREMRRNPLAGDVSISSPTMADDLHMKLLYLENRVAFARLFFPSEAKLAMEIAHAETTSEFAGLSASKRSSGNLREVDLNETPIMQNQRLRSRMNALVKTVEMGRRYFPHCSQVLDKFMEDDLPDLFYLEKGTLDEQRIKRTRFMELKEDVQRAFTKDKAEFNRSGLSSSSSSSSLKDNLSHKARKL

SEQ ID NO: 915 - DNA, 1755 bp, Eucalyptus grandis
  GSVIVT01026274001
atggctttttcgatggagccatcgtcatctttgagcttcacttcatcttcccatttgtccaataactccgtcagcaacaacgcagtaggtccttatggctctgagacagggcatagccctgatgccatcagtcttgggaaactcagctctagtttggagaggcttctttctgattccactcctgattatagcgatgccgatattgttgttgagaacatctcggttggtgttcatcgatgcattttggctgccaggagtgacttcttcaataaccttttcaagcgagagaagggatcctctgagaaggagggtaaaccaaagtataacatggacgatcttttgccttatggcaaggtcggatatgaagcctttctgattttcttgagctatgcatacacgggaaagctgaagcgttctccactggaggtttctacctgcgttgatgatatgtgtagccatgatgcatgtagcccagctatcaattttgcggtggagttgatgtatgcctcgtatatctttcagatccgggagctggtttcccttctccagcgacatcttgtcaactttgttgggaaggctcgatcggaagacatcatccccatcctcaccgtcgctttccactgtgaattgaatcaacttgagatgcaatgtgttgatagagtggctcgatctgatcttgacaacattgctcttgagaaagagcttccccctaaggttgcagaagagattaaattgctacgtctcaagtttcaacctaaagatgaaactaatttggaaattccagaccccttacgtgagaagagaattaagagaattcacaaagccttagactccgatgatattgaacttgttacgcttctcttgagcgagtccaatatcaacttagatgaagcctatggcttacattatgctgcagcttactgtgaccccaaggttgtctctgagttgcttggtttgggcttggctaacgtcaaccttcggaacccaaggggatacactgtgctccatgttgctgcaatgaggaaggagactaagataatagtctcattgttgtcaaaaggtgcttgtgcatcggaattgacacctgatggacagaatgctgtcagcatctgccgaaggttgacaaggcctaaggattataatgctaaaacagagcagtgccaggaagcaaacaaggacaggctatgcatagatgtactggagagggaattgtggaggaatccattggcaggagatgcttctgtttcgtatcctattgtatctgatgatctacacatgaagctgttgtatctggaaaacagagttgcatttgcaagactgttcttcccaactgaggctaaattagctatggatattgctcatgctgagatgacagctgagtttgctggtctttctgcaagaaaaggttctagtggaaatctgagggaggttgatttgaatgagacccccatagatcaaaacaaaagactgcgatctcgaatggaagccctccaaagaacagtggaaatgggtcggcgctactttcctaattgctcggaggtgctcgataagtttatggaggatgatctgcccgacctgtgctacctcgagaagggcacacctgatgaacagaggataaagacgagaaggttcatggaactcaaggacgacgtccagaaggccttctctaaagacaaggcagagatgagccggtcagggatctcttcttcatcgtcctcatcatccttaaaatacaataacaagattagaagatcg

SEQ ID NO: 916 - protein, 585 aa, Eucalyptus grandis
  GSVIVT01026274001 polypeptide
MAFSMEPSSSLSFTSSSHLSNNSVSNNAVGPYGSETGHSPDAISLGKLSSSLERLLSDSTPDYSDADIVVENISVGVHRCILAARSDFFNNLFKREKGSSEKEGKPKYNMDDLLPYGKVGYEAFLIFLSYAYTGKLKRSPLEVSTCVDDMCSHDACSPAINFAVELMYASYIFQIRELVSLLQRHLVNFVGKARSEDIIPILTVAFHCELNQLEMQCVDRVARSDLDNIALEKELPPKVAEEIKLLRLKFQPKDETNLEIPDPLREKRIKRIHKALDSDDIELVTLLLSESNINLDEAYGLHYAAAYCDPKVVSELLGLGLANVNLRNPRGYTVLHVAAMRKETKIIVSLLSKGACASELTPDGQNAVSICRRLTRPKDYNAKTEQCQEANKDRLCIDVLERELWRNPLAGDASVSYPIVSDDLHMKLLYLENRVAFARLFFPTEAKLAMDIAHAEMTAEFAGLSARKGSSGNLREVDLNETPIDQNKRLRSRMEALQRTVEMGRRYFPNCSEVLDKFMEDDLPDLCYLEKGTPDEQRIKTRRFMELKDDVQKAFSKDKAEMSRSGISSSSSSSSLKYNNKIRRS

SEQ ID NO: 917 - DNA, 1770 bp, Glycine max
  Glyma09g02430.1
atggcttattcagccgaaccctcatcatctttgagctttacctcatcttcccatctatctaatgggtcggttagtcacaacatatgcccttcttatggctctgatcctggacctaacttagaggctatcagtttgagtaagcttagctccaatttggagcagcttttgattgaacctgattgcgattatagtgatgctgaccttgttgtcgagggaattccggttagtgttcatcgatgtattctggcctctaggagtaagtttttccatgaattattcaagagggagaaggggtcatcagaaaaagaagggaaattgaagtataacatgaatgatttgttgccttatggcaaggttggatatgaagccttcctcatattccttggctatgtatatactggtaaactcaagccctctccaatggaggtgtctacttgtgttgacaatgtttgtgctcatgatgcgtgtagacctgccattaactttgctgttgagttaatgtatgcctcttccatttttcaaataccagagttggtatcacttttccagagacgtctacttaactttataggaaaggcccttgtggaagatgtcatcccaatcctcactgttgctttccattgtcaatcaaatcaacttgtcaatcaatgtattgatagggtggccagatcagaccttgaccagatttcaattgaccaagagcttccgcatgaactctcacaaaaagttaaattgctccgccgcaaacctcagcaagatgttgaaaatgatgcttctgtagtggatgctttgtctctaaaaagaatcactagaatacacaaggcgttggactcagatgatgttgagcttgttaaacttcttttgaatgaatcagacattactttggatgaagccaatgctctccattatgctgcagcctactgtgaccccaaggttgtttctgaggtacttggtttgggactggctaatgtcaatcttcgaaattctagggggtacacagtgcttcacattgctgccatgcgtaaagagccttccattatagtatccctacttacgaaaggggcttgtgcatcagatttgacttttgatggtcagagtgctgttagtatttgtaggaggttgacaaggccaaaggattatcatgcaaaaacagagcaggggaaagaaacaaacaaagatcggatatgcatcgatgttcttgaaagagaaatgaggaggaatccaatggctggggatgcctgtatgtcttcccataccatggctgatgatctccacatgaaactactgtaccttgagaacagagtggcatttgcaagacttttcttcccttcagaagccaaactagccatggacattgcgcatgctgagacaacatctgagtttgctggtctttctgcgtcaaactcaaaaggttcaaatggaaacttaagggaggttgatctcaatgagactcctatagtgcaaaataaaagacttctttctagaatggaagcccttacgaaaacagtggagatggggcggcgctacttcccacattgctcggaagtgctggacaagttcatggaggatgacctgcctgacttgttttaccttgaaaagggtactcatgaagagcagagaatcaaaaggacgcgtttcatggagcttaaagatgacgtccacaaggctttcaacaaggacaaggccgagtttagccgctctgggatttcatcttcatcatcctcatcatccctcagagattctgttgtacattacaaggctaggaaagtg

SEQ ID NO: 918 - protein, 590 aa, Glycine max
  Glyma09g02430.1 polypeptide
MAYSAEPSSSLSFTSSSHLSNGSVSHNICPSYGSDPGPNLEAISLSKLSSNLEQLLIEPDCDYSDADLVVEGIPVSVHRCILASRSKFFHELFKREKGSSEKEGKLKYNMNDLLPYGKVGYEAFLIFLGYVYTGKLKPSPMEVSTCVDNVCAHDACRPAINFAVELMYASSIFQIPELVSLFQRRLLNFIGKALVEDVIPILTVAFHCQSNQLVNQCIDRVARSDLDQISIDQELPHELSQKVKLLRRKPQQDVENDASVVDALSLKRITRIHKALDSDDVELVKLLLNESDITLDEANALHYAAAYCDPKVVSEVLGLGLANVNLRNSRGYTVLHIAAMRKEPSIIVSLLTKGACASDLTFDGQSAVSICRRLTRPKDYHAKTEQGKETNKDRICIDVLEREMRRNPMAGDACMSSHTMADDLHMKLLYLENRVAFARLFFPSEAKLAMDIAHAETTSEFAGLSASNSKGSNGNLREVDLNETPIVQNKRLLSRMEALTKTVEMGRRYFPHCSEVLDKFMEDDLPDLFYLEKGTHEEQRIKRTRFMELKDDVHKAFNKDKAEFSRSGISSSSSSSSLRDSVVHYKARKV

SEQ ID NO: 919 - DNA, 1761 bp, Populus trichocarpa
  POPTR_0012s11900.1
atggctaatttctctgagctatcatcatctttgagttttacttcatcttctcatatgtcaaatggctcaattagtcacaatatatccaactcctcggttgctgaggcaggaactagtcttgaggtgattagtttaaataagctgagctccagtttggagcagctattgattgagtctacttgtgaatatagtgatgctgatattgttgttgagggtatcgctgttggtgttcatcgatgtattttagcttctaggagcaagtttttccatgagttgtttaggagagaaaaggggtctctggagaaggatggaaaaccaaagtattgcatgagtgaattgttaccttatggaaatgttggatatgaagccttcctaattttcttgagctatttgtatactggaaaactcaagccatctccaatggaagtctcaacatgtgttgataatgtatgcgctcatgattcgtgtagacctgcgattacttttgcagtggaattgacgtatgcatcatccatatttcaagttccagagctggtttcacttttccagagacgccttcttaactttgttcggaaagctcttgcggaagatgtgatcccaatccttgtggttgccttccattgtcaatcaagtcagcttattgcacaatgtgttgatagaatagcagtgtctaatcttgacaacatctctatagagaaagagcttccccatgaagttgcagacaaaattaaacagctccgccgcaaacctatttctgatgatgaaaacaacacagaggctggggaccccctacgtgaaaagagaatcaagaggatacacatggcattggactcagatgatgttgaacttgtgaaacttctcctgactgagtctgatatatccttagatgacgctaacgctctccattattgtgcatcatactgtgatctcaaggttatgtctgaggtgcttagccttggtcttgctaatgtcaatcttagaaactcgcgaggttacacagttcttcacattgctgcaatgcggaaagagccatcagtgatagtttcgttgctggccaaaggagcatctgctttggacttgacatcagatgggcaaagtgctgttagtatctgccggaggttgacaaggccaaaagactatcatgctaaaacagagcaagggcaggaagcaaacaaagacaggttatgcatcgatattttagagagggaaatgagaaggaatccacggggtgggagtgcttccatcacttcccatacaatggttgatgatctgcacatgaagctgttatacctggagaacagagtggcatttgcacgattattcttccctactgaagcaaagctagcaatggacattgcacatgctgcaacaacatcagaatttgctggtcttgctgcatcaaaaggttctagcgggaatttgagggaggttgacctgaatgagacaccaattatgcagaacaaaagacttcgttctaggatggaagccctaatgaaaacagtggaaatgggccgacgatacttccctaattgctctgaagtgcttgataagttcatggaggatgacctccctgatttgtttttccttgaaaagggcaccccagatgaacaaagaatcaagaggacacgtttcatggaacttaaagaggatgttcaaaaggcatttaacaaggacaaggctgtgattaaccgctctgttttgtcttcctcgtcatcctcatcttctcaaaaagatggtgttggtaacaagctcaggaaacta

SEQ ID NO: 920 - protein, 587 aa, Populus trichocarpa
  POPTR_0012s11900.1 polypeptide
MANFSELSSSLSFTSSSHMSNGSISHNISNSSVAEAGTSLEVISLNKLSSSLEQLLIESTCEYSDADIVVEGIAVGVHRCILASRSKFFHELFRREKGSLEKDGKPKYCMSELLPYGNVGYEAFLIFLSYLYTGKLKPSPMEVSTCVDNVCAHDSCRPAITFAVELTYASSIFQVPELVSLFQRRLLNFVRKALAEDVIPILVVAFHCQSSQLIAQCVDRIAVSNLDNISIEKELPHEVADKIKQLRRKPISDDENNTEAGDPLREKRIKRIHMALDSDDVELVKLLLTESDISLDDANALHYCASYCDLKVMSEVLSLGLANVNLRNSRGYTVLHIAAMRKEPSVIVSLLAKGASALDLTSDGQSAVSICRRLTRPKDYHAKTEQGQEANKDRLCIDILEREMRRNPRGGSASITSHTMVDDLHMKLLYLENRVAFARLFFPTEAKLAMDIAHAATTSEFAGLAASKGSSGNLREVDLNETPIMQNKRLRSRMEALMKTVEMGRRYFPNCSEVLDKFMEDDLPDLFFLEKGTPDEQRIKRTRFMELKEDVQKAFNKDKAVINRSVLSSSSSSSSQKDGVGNKLRKL

SEQ ID NO: 921 - DNA, 1770 bp, Glycine max
  Glyma15g13320.1
atggcttattcagccgaaccctcatcatctttgagctttacctcatcttcccatctatcaaatgggtcggttagtcacaacatatgctcttcttatggctctgaccctggacctaaccttgaggctctcagtttgagtaagcttagctccaattttgagcagcttttgattgaaactgattgtgattatagtgatgctgacatcgttgtggagggaatttcggttagtgttcatcgatgtattctggcctctaggagtaagtttttccatgaattattcaagagagagaagggttcatcagaaaaagaagggaaattgaagtataacatgagtgatttgttgccttatggcaaggttggatatgaagccttcctcatattccttggctatgtatatactggtaaactcaagccctctccaatggaagtgtctacttgtgttgacagtgtgtgtgcccatgatgcttgtagacctgccattaactttgctgtggagttgatgtatgcctcttacatttttcaaataccagagtttgtatcacttttccagagacgtctacttaactttatagggaaggctcttgtggaagatgtcatcccaatcctcactgttgctttccattgtcaattgagtcaacttgtcaatcaatgcattgatagggtggccagatcagaccttgaccagatttcaattgaccaagagcttccaaatgaactctcacaaaaagttaaattgctccgccgcaaccctcagcgagatgttgaaaacgatgcttctatagtggatgctttgtctctaaaaagaatcactagaatacacaaggcattggattcagatgatgttgagcttgttaaacttcttttaaatgaatcagacattactttagatgaagccaatgctctccattatgctgcagcctactgtgatcccaaggttgtttctgaggtacttggtttgggactcgctaatgtcaatcttcgaaattctagggggtacacagtgcttcacattgctgccatgcgtaaagagccttccattatagtatccctacttacgaaaggggcttgtgcatcagatttgacttttgatggtcagagtgctgttagtatttgtaggaggttgacaaggccaaaggattatcatgcaaaaacagagcaggggaaagaaacaaacaaagatcggatatgcatcgatgttcttgaaagagaaatgtggaggaatccattggctggggatgcctgtatgtcttcccataccatggctgatgatctccacatgaaactactataccttgagaacagagtggcatttgcaagacttttcttcccttcagaagccaaactagccatggacattgcacatgctgagacaacatctgagtttgctggtctttctgcatcaaactcaaaaggttcaaatggaaacttaagggaggttgatctcaatgaaactcctatagttcaaagtaaaagacttttttctagaatggaagcccttatgaaaacagtggagatggggcggcgctacttcccgcattgctcggaagtgttggataagttcatggaggatgacttgcctgacttgttttaccttgaaaagggtactaatgaagagcagagaatcaaaaggacacgtttcatggagcttaaagatgacgtccacaaggctttcaacatggacaaggccgagtttagccgctctgggatttcatcttcatcatcctcatcatccctcagagattctgttgtacattacaaggctaggaaagtg

SEQ ID NO: 922 - protein, 590 aa, Glycine max
  Glyma15g13320.1 polypeptide
MAYSAEPSSSLSFTSSSHLSNGSVSHNICSSYGSDPGPNLEALSLSKLSSNFEQLLIETDCDYSDADIVVEGISVSVHRCILASRSKFFHELFKREKGSSEKEGKLKYNMSDLLPYGKVGYEAFLIFLGYVYTGKLKPSPMEVSTCVDSVCAHDACRPAINFAVELMYASYIFQIPEFVSLFQRRLLNFIGKALVEDVIPILTVAFHCQLSQLVNQCIDRVARSDLDQISIDQELPNELSQKVKLLRRNPQRDVENDASIVDALSLKRITRIHKALDSDDVELVKLLLNESDITLDEANALHYAAAYCDPKVVSEVLGLGLANVNLRNSRGYTVLHIAAMRKEPSIIVSLLTKGACASDLTFDGQSAVSICRRLTRPKDYHAKTEQGKETNKDRICIDVLEREMWRNPLAGDACMSSHTMADDLHMKLLYLENRVAFARLFFPSEAKLAMDIAHAETTSEFAGLSASNSKGSNGNLREVDLNETPIVQSKRLFSRMEALMKTVEMGRRYFPHCSEVLDKFMEDDLPDLFYLEKGTNEEQRIKRTRFMELKDDVHKAFNMDKAEFSRSGISSSSSSSSLRDSVVHYKARKV

SEQ ID NO: 923 - protein, 125 aa, Arabidopsis thaliana
  AT5G45110.1 BTB domain
DAEIIVDGVPVGVHRCILAARSKFFQDLFKKEKKISKTEKPKYQLREMLPYGAVAHEAFLYFLSYIYTGRLKPFPLEVSTCVDPVCSHDCCRPAIDFVVQLMYASSVLQVPELVSSFQRRLCNFV

SEQ ID NO: 924 - protein, 144 aa, Zea mays
  GRMZM2G076450_T01 BTB domain
DADVDVPDGGPPVPIHRCILAARSDFFYDLFAARGRAGAARGDAAAGAGVAAEGAASGRPRYKMEDLVPAGRVGREAFQAFLGYLYTGKLRPAPVDVVSCADPVCHHDSCPPAIRSAVELMYAACTFKIPELTSLFQRRLLNFV

SEQ ID NO: 925 - protein, 144 aa, Setaria italica
  Si000647m BTB domain
DADIEVPDGGPPVPVHRCILAVRSPFFYDIFAARGRGGAARGDAAAGARGAGEGAASGRPRYKMEELVPGGRVGREAFQAFLGYLYTGKLRPAPLDVVSCADPVCPHDSCPPAIRFAVELMYAAWTFKIPELISLFQRRLLNFV

SEQ ID NO: 926 - protein, 144 aa, Setaria italica; identical to SEQ ID NO: 925
  Si000671m BTB domain

SEQ ID NO: 927 - protein, 126 aa, Solanum lycopersicum
  Solyc07g044980.2.1 BTB domain
DAEIVVEGINVGVNRCILAARSQFFHEKFKEKNENSLKNEKPKYLLKDLVCVSSIGYEVFMVLLNYLYTGKIKSSPSEVSSCVDNACAHDACRPAINYAVELMYASSTFQIKELVMFVERYLDNFV

SEQ ID NO: 928 - protein, 145 aa, Brachypodium distachyon
  Bradi2g51030.1 BTB domain
DADVDMADGGPLVPVHRCILAARSPFFHEFFAARGRGNSGDGPPSASAAGVGGGGEGTGRPRYKMEELVPGGRVGREAFLGFMRYLYTGKLRPAPPDVVSCVDPVCPHDSCPPAIRFAVELMYAASTFNIPELISLFQRRLLNFV

SEQ ID NO: 929 - protein, 144 aa, Oryza sativa
  LOC_Os01g56200.1 BTB domain
DADVDVADGGPPVPVHRCILAARSTFFYNLFAARGRGGDGAAGGGGGGGGGGGERTGGRPRYKMEELVPGGRVGRDAFLSLLGYLYTGKLRPAPDDVVSCADPMCPHDSCPPAIRFNVEQMYAAWAFKITELISLFQRRLLNFV

SEQ ID NO: 930 - protein, 131 aa, Brachypodium distachyon
  Bradi1g12870.1 BTB domain
DAEVVLADGGDEATVPVHRCILAARSNFFLDHFSSLSSPAAGGGKPRLELAELVPGGRHVGHEALVAVLGYLYTGRLKPPPQEAAICVDDRCRHQACRPAIDFVVESTYAASGFQISELVSLFQRRLSDFV

SEQ ID NO: 931 - protein, 137 aa, Oryza sativa
  LOC_Os03g46440.3 BTB domain
DAEIVLASGGGDPGGGAVVGVHRCILAARSRFFYDHFSSAPAPAPATAGDKPQLDLDGLVPGGRHIGRDALVAVLSYLYTGRLRSAPPEAAACLDDGCSHDACRPAIDFVVESTYAASGFQISELVSLFQRRLSDFV

SEQ ID NO: 932 - protein, 131 aa, Setaria italica
  Si034834m BTB domain
DAEVALAAGKGGAAVGVHRCILAARSAFFRDHFASLPPPAAVGEKPRLELADLVPGGRHIGQDALVPVLGYLYTGRLKSAPQDATVCMDDACGHGACRPAIDFVVESMYAASGFQISELVSLFQRRLSDFV

SEQ ID NO: 933 - protein, 137 aa, Oryza sativa; identical to SEQ ID NO: 931
  LOC_Os03g46440.1 BTB domain

SEQ ID NO: 934 - protein, 137 aa, Oryza sativa; identical to SEQ ID NO: 931
  LOC_Os03g46440.2 BTB domain

SEQ ID NO: 935 - protein, 131 aa, Zea mays
  GRMZM2G115162_T01 BTB domain
DAEIALAAARGGGAVGVHRCILAARSAFFLDHLASLPAPAAAGERPRLELADLVPGGRHIGRDALVPVLGYLYTGRLKPPAQDATVCMDDACGHGTCRPAIDFVVESMYAASGFQISELASLFQRRLSDFV

SEQ ID NO: 936 - protein, 126 aa, Citrus clementina
  clementine0.9_005201m BTB domain
DAEIVVEGKSVAVNRSILSERSQFFRRLFNLRNDGSVSEGKPKYLLTDLVPHGKVGYEAFNDTLHYIYTGKTKAPPPEVSTCVDDACVHVSCPPTINYVIELMYASAALQMKKLVIRLELWLLNLV

SEQ ID NO: 937 - protein, 129 aa, Citrus clementina
  clementine0.9_005587m BTB domain
DAEIVVEGKSVALHRCILSARSQFFHELFKKGNNNDGSAVSEGKPKYLMTELVPYGKVGYEALNVILYYFYTGKLKPSPSEVSTCVDDACAHDACPPAINYAIELMYASAAFQMKELVLLFQRRLLNFV

SEQ ID NO: 938 - protein, 126 aa, Glycine max
  Glyma02g45260.1 BTB domain
DAEILVEDIPVGIHRCILASRSLFFHELFKKGTDGSGKEGKPRYLMSDLVPYGTVGYEAFQVFLYYLYTGRLKASPTEVTTCVDETCTHDACRPAINYALELMYASATFQMKELVLLFQRHLLNFV

SEQ ID NO: 939 - protein, 126 aa, Glycine max
  Glyma14g03510.1 BTB domain
DAEILIEDIPVGIHRCILASRSPFFHELFKKGTDGSGKEGKPRYLMSDLMPYGTVGYQAFQVFLYYLYTGRLKASPTEETTCVDETCIHVACRPAINHALELMYASATFQMKELVLLFQRHLLNFV

SEQ ID NO: 940 - protein, 126 aa, Glycine max; identical to SEQ ID NO: 938
  Glyma02g45260.2 BTB domain

SEQ ID NO: 941 - protein, 126 aa, Eucalyptus grandis
  Eucgr.A02033.1 BTB domain
DAVIVVEGVPVGVHRCLLAARSQFLHEFFKQGGGDNAREGKPRYPISDLVKKGHVGCEAFKYVLRYMYTGKLKLFPAEVSTCVDSSCAHDVCGPAINYAVELMYASATFEIAELVMLVQRRLLHFI

SEQ ID NO: 942 - protein, 126 aa, Eucalyptus grandis; identical to SEQ ID NO: 941
  Eucgr.A02033.2 BTB domain

SEQ ID NO: 943 - protein, 126 aa, Populus trichocarpa
  POPTR_0002s05740.1 BTB domain
DAEIFVEGTPVGVHRCVLAARSQFFHELFKKGNNNSTNGDKPRYLMSDLVPYGGVGYEAFHVFLHYLYTGKLKPSPPEVSRCVDDACAHDVCRPAINYVVELMCASATFQMKELVLLFQRRLLNFI

SEQ ID NO: 944 - protein, 126 aa, Populus trichocarpa
  POPTR_0005s22770.1 BTB domain
DAEIVVEGIPVGVHRCILAARSQFFHELFKKVDSNSTSGDKPRYLMSDLMPYGGVGYEAFNVFLHYLYTGKHKSSPPEVSQCVYDACAHDACRPAINYAVELMYASATFQMKELVLLFQRRLLSFI

SEQ ID NO: 945 - protein, 126 aa, Populus trichocarpa
  POPTR_0015s15800.1 BTB domain
DADIVVEGTAIGVHRCILGARSKFFHELFRREKGSSEKEGKPKYCMSDLLPCGKVGYEAFLIFLSYLYTGKLKPSPMEVSTCVDNVCAHDACRPAINFAVELMYASSIFQVPELVSLFQRRLQNFV

SEQ ID NO: 946 - protein, 126 aa, Solanum lycopersicum
  Solyc02g069310.2.1 BTB domain
DAEIVVEGVSLGVHRCILAARSSFFRDLFRKRNGNCGKEGKPSYSMIDILPCGKVGYEAFLTFLSYLYSGKLKHFPPEASTCVNSLCSHDSCRPAINFHVELMYASFVFQVPELVSLFLRHLFSFV

SEQ ID NO: 947 - protein, 126 aa, Eucalyptus grandis
  Eucgr.E01922.1 BTB domain
DADIVVENISVGVHRCILAARSDFFNNLFKREKGSSEKEGKPKYNMDDLLPYGKVGYEAFLIFLSYAYTGKLKRSPLEVSTCVDDMCSHDACSPAINFAVELMYASYIFQIRELVSLLQRHLVNFV

SEQ ID NO: 948 - protein, 126 aa, Glycine max
  Glyma09g02430.1 BTB domain
DADLVVEGIPVSVHRCILASRSKFFHELFKREKGSSEKEGKLKYNMNDLLPYGKVGYEAFLIFLGYVYTGKLKPSPMEVSTCVDNVCAHDACRPAINFAVELMYASSIFQIPELVSLFQRRLLNFI

SEQ ID NO: 949 - protein, 126 aa, Populus trichocarpa
  POPTR_0012s11900.1 BTB domain
DADIVVEGIAVGVHRCILASRSKFFHELFRREKGSLEKDGKPKYCMSELLPYGNVGYEAFLIFLSYLYTGKLKPSPMEVSTCVDNVCAHDSCRPAITFAVELTYASSIFQVPELVSLFQRRLLNFV

SEQ ID NO: 950 - protein, 126 aa, Glycine max
  Glyma15g13320.1 BTB domain
DADIVVEGISVSVHRCILASRSKFFHELFKREKGSSEKEGKLKYNMSDLLPYGKVGYEAFLIFLGYVYTGKLKPSPMEVSTCVDSVCAHDACRPAINFAVELMYASYIFQIPEFVSLFQRRLLNFI

SEQ ID NO: 951 - protein, 90 aa, Arabidopsis thaliana
  AT5G45110.1 ANK domain
ILKALDSDDVELVKLLLTESDITLDQANGLHYSVVYSDPKVVAEILALDMGDVNYRNSRGYTVLHFAAMRREPSIIISLIDKGANASEFT

SEQ ID NO: 952 - protein, 90 aa, Zea mays
  GRMZM2G076450_T01 ANK domain
IHRALDSDDVELVKLLLNESDITLDDANALHYAASYCDPKVVSELLDLAMANLNLKNSRGYTALHLAAMRREPAIIMCLLNKGANVSQLT

SEQ ID NO: 953 - protein, 90 aa, Setaria italica
  Si000647m ANK domain
IHRALDSDDVELVKLLLNESEITLDDANALHYAASYCDSKVVSELLELGLANLNLKNSRGYTALHLAAMRREPAIIMCLLNKGATVSQLT

SEQ ID NO: 954 - protein, 90 aa, Setaria italica; identical to SEQ ID NO: 953
  Si000671m ANK domain

SEQ ID NO: 955 - protein, 91 aa, Solanum lycopersicum
  Solyc07g044980.2.1 ANK domain
ILKALESDDIELLTLLLEESNVTLNDACALHYAAAYCNSKVVNEVLELGLGADVNLQNSRGYNVLHVAARRKEPSIIMGLLAKGASVLDTT

SEQ ID NO: 956 - protein, 90 aa, Brachypodium distachyon
  Bradi2g51030.1 ANK domain
IHRALDSDDVELVKLLLNESEITLDDANALHYAAAYCDSKVVSELLDLGLANLNLKNNRGYTALHLAAMRREPTIIMCLLNKGAVASQLT

SEQ ID NO: 957 - protein, 90 aa, Oryza sativa
  LOC_Os01g56200.1 ANK domain
IHRALDSDDVELVKLLLNESEITLDDANALHYAAAYCDSKVVSELLDLRLANLNLKNSRGYTALHLAAMRREPAIIMCLLNKGAAVSQLT

SEQ ID NO: 958 - protein, 90 aa, Brachypodium distachyon
  Bradi1g12870.1 ANK domain
IHKALDSDDVALVGMLLKESAITLDDAHAIHYAAAYCEPKVLAGMLNLDSANVNLKNDSGYTPLHIACMRREPDIIVSLIEKGASVLERT

SEQ ID NO: 959 - protein, 90 aa, Oryza sativa
  LOC_Os03g46440.3 ANK domain
IHKALDSDDVDLVGMLLKESPVTLDDAFAIHYAAAYCEPKVLAELLKLESANVNLKNSSGYTPLHMACMRREPDIIVSLIEKGASVLERT

SEQ ID NO: 960 - protein, 90 aa, Setaria italica
  Si034834m ANK domain
ILKALDSDDVDLVGLLLKESAVTLDDAFAVHYAAAYCEPKVFAELLKLNSANVNLKNNSGYTPLHIACMRREPDIILSLVERGASVMERT

SEQ ID NO: 961 - protein, 90 aa, Oryza sativa; identical to SEQ ID NO: 959
  LOC_Os03g46440.1 ANK domain

SEQ ID NO: 962 - protein, 90 aa, Oryza sativa; identical to SEQ ID NO: 959
  LOC_Os03g46440.2 ANK domain

SEQ ID NO: 963 - protein, 90 aa, Zea mays
  GRMZM2G115162_T01 ANK domain
ILKALDSDDVDLVGLLLKESTVTLDDAFAIHYAAAYCEPKVFAELLKLDSANVNLKNSGGYTPLHIACMRREPDIILSLVERGACVLERT

SEQ ID NO: 964 - protein, 90 aa, Citrus clementina
  clementine0.9_005201m ANK domain
IHKALDSDDVELLKLLLDVSNVTLDDAYALHYAAAYCSPKVFKEVLNMDLACLNLKDARGRTVLHVAARRNEPEVMVTLLSKGACASETT

SEQ ID NO: 965 - protein, 90 aa, Citrus clementina
  clementine0.9_005587m ANK domain
IHKALDSDDVELLKLLLDESNVTLDDAYALHYAAAYCNPKVFKEVLNMGLADLNLKNARGHTVLHVAARRKEPAVLVTLLSKGACASETT

SEQ ID NO: 966 - protein, 90 aa, Glycine max
  Glyma02g45260.1 ANK domain
IHKALDSDDVELLKLLLNESSVTLDDAHALHYACAYSDSKVIQEVLSLGMADILRRNSRGYTVLHVAARRKDPSILVALLNKGACASDTT

SEQ ID NO: 967 - protein, 90 aa, Glycine max
  Glyma14g03510.1 ANK domain
IHKALDSDDVELLKLLLNESSVTLDDAYALHYACAYSDSKVIQEVLSLGMADILRRNSRGYTVLHVAARRKDPSILVALLNKGARASDTT

SEQ ID NO: 968 - protein, 90 aa, Glycine max; identical to SEQ ID NO: 966
  Glyma02g45260.2 ANK domain

SEQ ID NO: 969 - protein, 90 aa, Eucalyptus grandis
  Eucgr.A02033.1 ANK domain
IHKALDNDDVELVRRLLNESVVTLDDAYALHYATAYCHPKIFKEVLGLGLADLNLKDSRGYTVLHVAARRKAPSILLPLLYKGACAMEST

SEQ ID NO: 970 - protein, 90 aa, Eucalyptus grandis; identical to SEQ ID NO: 969
  Eucgr.A02033.2 ANK domain

SEQ ID NO: 971 - protein, 90 aa, Populus trichocarpa
  POPTR_0002s05740.1 ANK domain
IHKALDSDDVELVELLLSESNLTLDDAYALHYAVAYCDPKIVKEVLSLGSADLNLRNSRGYSVLHVAARRKEPSIIMALLTRGASASETT

SEQ ID NO: 972 - protein, 91 aa, Populus trichocarpa
  POPTR_0005s22770.1 ANK domain
IHKALESDDVELVQLLLSESNFTLDDAYALHYAVSYCDPKVVKEVLALGLADLNLRNSRGYTVLHVAARRKESSILVALLAKGARASEITM

SEQ ID NO: 973 - protein, 90 aa, Populus trichocarpa
  POPTR_0015s15800.1 ANK domain
IHMALDSDDVELVKLLLTESDITLDDANALHYAASYCDLKVVSEVLSLGLADVNLRNSRGYTVLHIAAMRKEPSVIVSMLAKGASALDLT

SEQ ID NO: 974 - protein, 90 aa, Solanum lycopersicum
  Solyc02g069310.2.1 ANK domain
IYKALDSDDVELVKLLLNESDISLDGAYALHYAVAYCDPKVVAEVLGLGVANVNLRNARGYTVLHIAAMRKEPSIIVSLLTKGAHASEIT

SEQ ID NO: 975 - protein, 90 aa, Glycine max
  Glyma15g13320.2 ANK domain
IHKALDSDDVELVKLLLNESDITLDEANALHYAAAYCDPKVVSEVLGLGLANVNLRNSRGYTVLHIAAMRKEPSIIVSLLTKGACASDLT

SEQ ID NO: 976 - protein, 90 aa, Vitis vinifera
  GSVIVT01026274001 ANK domain
ILKALDSDDVELVKLLLSESGITLDEAYALHYAAAYCDPKVVSEVLSLGLADVNRHNPRGYTVLHVAAMRKEPSIIVSLLTKGAHASERT

SEQ ID NO: 977 - protein, 90 aa, Eucalyptus grandis
  Eucgr.E01922.1 ANK domain
IHKALDSDDIELVTLLLSESNINLDEAYGLHYAAAYCDPKVVSELLGLGLANVNLRNPRGYTVLHVAAMRKETKIIVSLLSKGACASELT

SEQ ID NO: 978 - protein, 90 aa, Glycine max; identical to SEQ ID NO: 975
  Glyma09g02430.1 ANK domain

SEQ ID NO: 979 - protein, 90 aa, Populus trichocarpa
  POPTR_0012s11900.1 ANK domain
IHMALDSDDVELVKLLLTESDISLDDANALHYCASYCDLKVMSEVLSLGLANVNLRNSRGYTVLHIAAMRKEPSVIVSLLAKGASALDLT

SEQ ID NO: 980 - protein, 90 aa, Glycine max; identical to SEQ ID NO: 975
  Glyma15g13320.1 ANK domain

SEQ ID NO: 981 - protein, 37 aa, Arabidopsis thaliana
  1st consensus sequence in BTB domains of AtNPR3 clade
  misc_feature (3)..(3): Xaa can be any naturally occurring amino acid
  misc_feature (4)..(4): Xaa can be Ile, Val, Leu, or Met
  misc_feature (5)..(5): Xaa can be any naturally occurring amino acid
  misc_feature (6)..(6): Xaa can be Ile, Val, Leu, or Met
  misc_feature (7)..(7): Xaa can be any naturally occurring amino acid
  misc_feature (8)..(15): Xaa can be any naturally occurring amino acid or absent
  misc_feature (16)..(18): Xaa can be any naturally occurring amino acid
  misc_feature (19)..(19): Xaa can be Ile, Val, Leu, or Met
  misc_feature (20)..(20): Xaa can be any naturally occurring amino acid
  misc_feature (21)..(21): Xaa can be Ile, Val, Leu, or Met
  misc_feature (22)..(22): Xaa can be His or Asn
  misc_feature (24)..(24): Xaa can be Cys or Ser
  misc_feature (25)..(25): Xaa can be Ile, Val, Leu, or Met
  misc_feature (27)..(27): Xaa can be Ser, Ala, or Thr
  misc_feature (28)..(28): Xaa can be any naturally occurring amino acid
  misc_feature (31)..(31): Xaa can be any naturally occurring amino acid
  misc_feature (33)..(33): Xaa can be any Phe or Leu
  misc_feature (34)..(36): Xaa can be any naturally occurring amino acid
  misc_feature (37)..(37): Xaa can be any Phe or Leu
DAXXXXXXXXXXXXXXXXXXXXRXXLXXRSXFXXXXX

SEQ ID NO: 982 - protein, 87 aa, Arabidopsis thaliana
  2nd consensus sequence in BTB domains of the AtNPR3 clade
  misc_feature (1)..(1): Xaa can be Lys or Arg
  misc_feature (2)..(5): Xaa can be any naturally occurring amino acid
  misc_feature (6)..(6): Xaa can be Ile, Val, Leu, or Met
  misc_feature (7)..(8): Xaa can be any naturally occurring amino acid
  misc_feature (9)..(10): Xaa can be Ile, Val, Leu, or Met
  misc_feature (11)..(12): Xaa can be any naturally occurring amino acid
  misc_feature (13)..(13): Xaa can be Gly or Ser
  misc_feature (14)..(14): Xaa can be any naturally occurring amino acid
  misc_feature (15)..(15): Xaa can be His or absent
  misc_feature (16)..(16): Xaa can be Ile, Val, Leu, or Met
  misc_feature (17)..(18): Xaa can be Ile, Val, Leu, or Met
  misc_feature (19)..(19): Xaa can be Glu, Lys, or Gln
  misc_feature (20)..(20): Xaa can be any naturally occurring amino acid
  misc_feature (21)..(21): Xaa can be Phe or Leu
  misc_feature (22)..(24): Xaa can be any naturally occurring amino acid
  misc_feature (25)..(25): Xaa can be Ile, Val, Leu, or Met
  misc_feature (26)..(26): Xaa can be any naturally occurring amino acid
  misc_feature (28)..(28): Xaa can be any naturally occurring amino acid
  misc_feature (30)..(30): Xaa can be Ser, Ala, or Thr
  misc_feature (32)..(32): Xaa can be Lys or Arg
  misc_feature (33)..(33): Xaa can be any naturally occurring amino acid
  misc_feature (34)..(34): Xaa can be Lys or Arg
  misc_feature (35)..(38): Xaa can be any naturally occurring amino acid
  misc_feature (39)..(39): Xaa can be Glu or Asp
  misc_feature (40)..(42): Xaa can be any naturally occurring amino acid
  misc_feature (44)..(47): Xaa can be any naturally occurring amino acid
  misc_feature (49)..(49): Xaa can be any naturally occurring amino acid
  misc_feature (51)..(52): Xaa can be any naturally occurring amino acid
  misc_feature (54)..(54): Xaa can be any naturally occurring amino acid
  misc_feature (56)..(56): Xaa can be Ser, Ala, or Thr
  misc_feature (58)..(60): Xaa can be any naturally occurring amino acid
  misc_feature (61)..(61): Xaa can be Ile, Val, Leu, or Met
  misc_feature (62)..(62): Xaa can be Glu or Gln
  misc_feature (63)..(65): Xaa can be any naturally occurring amino acid
  misc_feature (67)..(67): Xaa can be Ser, Ala, or Thr
  misc_feature (68)..(69): Xaa can be any naturally occurring amino acid
  misc_feature (70)..(70): Xaa can be Phe or Leu
  misc_feature (71)..(71): Xaa can be any naturally occurring amino acid
  misc_feature (72)..(72): Xaa can be Ile, Val, Leu, or Met
  misc_feature (73)..(74): Xaa can be any naturally occurring amino acid
  misc_feature (75)..(75): Xaa can be Ile, Val, Leu, or Met
  misc_feature (76)..(82): Xaa can be any naturally occurring amino acid
  misc_feature (84)..(85): Xaa can be any naturally occurring amino acid
  misc_feature (86)..(86): Xaa can be Phe or Leu
  misc_feature (87)..(87): Xaa can be Ile, Val, Leu, or Met
XXXXXXXXXXXXXXXXXXXXXXXXXXYXYXGXXXXXXXXXXXCXXXXCXHXXCXPXIXXXXXXXXAXXXXXXXXXXXXXXXXLXXXX

SEQ ID NO: 983 - protein, 89 aa, Arabidopsis thaliana
  consensus sequence in ANK domains of the AtNPR3 clade
  misc_feature (2)..(3): Xaa can be any naturally occurring amino acid
  misc_feature (6)..(6): Xaa can be Glu or Asp
  misc_feature (7)..(7): Xaa can be any naturally occurring amino acid
  misc_feature (10)..(10): Xaa can be Ile, Val, Leu, or Met
  misc_feature (11)..(11): Xaa can be any naturally occurring amino acid
  misc_feature (13)..(13): Xaa can be Ile, Val, Leu, or Met
  misc_feature (14)..(15): Xaa can be any naturally occurring amino acid
  misc_feature (18)..(19): Xaa can be any naturally occurring amino acid
  misc_feature (21)..(23): Xaa can be any naturally occurring amino acid
  misc_feature (25)..(25): Xaa can be Asp or Asn
  misc_feature (26)..(26): Xaa can be any naturally occurring amino acid
  misc_feature (28)..(29): Xaa can be any naturally occurring amino acid
  misc_feature (30)..(30): Xaa can be Ile, Val, Leu, or Met
  misc_feature (33)..(35): Xaa can be any naturally occurring amino acid
  misc_feature (37)..(37): Xaa can be Cys or Ser
  misc_feature (38)..(39): Xaa can be any naturally occurring amino acid
  misc_feature (41)..(41): Xaa can be Ile, Val, Leu, or Met
  misc_feature (42)..(44): Xaa can be any naturally occurring amino acid
  misc_feature (45)..(45): Xaa can be Ile, Val, Leu, or Met
  misc_feature (47)..(47): Xaa can be any naturally occurring amino acid
  misc_feature (48)..(48): Xaa can be Ile, Val, Leu, or Met
  misc_feature (49)..(50): Xaa can be any naturally occurring amino acid
  misc_feature (51)..(51): Xaa can be Gly or absent
  misc_feature (52)..(53): Xaa can be any naturally occurring amino acid
  misc_feature (54)..(54): Xaa can be Ile, Val, Leu, or Met
  misc_feature (55)..(56): Xaa can be any naturally occurring amino acid
  misc_feature (57)..(57): Xaa can be any Lys, Arg, or Gln
  misc_feature (58)..(58): Xaa can be any Asp or Asn
  misc_feature (59)..(60): Xaa can be any naturally occurring amino acid
  misc_feature (62)..(64): Xaa can be any naturally occurring amino acid
  misc_feature (67)..(67): Xaa can be any naturally occurring amino acid
  misc_feature (69)..(70): Xaa can be any naturally occurring amino acid
  misc_feature (72)..(75): Xaa can be any naturally occurring amino acid
  misc_feature (76)..(78): Xaa can be Ile, Val, Leu, or Met
  misc_feature (79)..(79): Xaa can be any naturally occurring amino acid
  misc_feature (80)..(81): Xaa can be Ile, Val, Leu, or Met
  misc_feature (82)..(82): Xaa can be any naturally occurring amino acid
  misc_feature (83)..(83): Xaa can be Lys or Arg
  misc_feature (86)..(88): Xaa can be any naturally occurring amino acid
  misc_feature (89)..(89): Xaa can be Glu, Asp, or Gln
IXXALXXDDXXLXXXLLXXSXXXLXXAXXXHYXXXYXXXKXXXXXLXXXXXXXXXXXXXXGXXXLHXAXXRXXXXXXXXXXXXGAXXXX

SEQ ID NO: 984 - protein, 13 aa, Arabidopsis thaliana
  AtNPR3 clade consensus sequence between BTB and DUF3420 domains
  misc_feature (1)..(1): Xaa can be Ser, Ala, or Thr
  misc_feature (2)..(3): Xaa can be any naturally occurring amino acid
  misc_feature (4)..(4): Xaa can be Glu or Asp
  misc_feature (5)..(5): Xaa can be Asp or Asn
  misc_feature (6)..(7): Xaa can be Ile, Val, Leu, or Met
  misc_feature (9)..(10): Xaa can be Ile, Val, Leu, or Met
  misc_feature (11)..(12): Xaa can be any naturally occurring amino acid
XXXXXXXPXXXXA

SEQ ID NO: 985 - protein, 12 aa, Arabidopsis thaliana
  AtNPR3 clade consensus sequence near start of DUF3420 domains
  misc_feature (2)..(2): Xaa can be any naturally occurring amino acid
  misc_feature (3)..(3): Xaa can be Ile, Val, Leu, Met, or Phe
  misc_feature (4)..(7): Xaa can be any naturally occurring amino acid
  misc_feature (8)..(8): Xaa can be Ile, Val, Leu, or Met
  misc_feature (9)..(9): Xaa can be Glu or Asp
  misc_feature (10)..(10): Xaa can be Lys, Arg, or Gln
  misc_feature (11)..(11): Xaa can be Glu or Arg
  misc_feature (12)..(12): Xaa can be Ile, Val, Leu, or Met
SXXXXXXXXXXX

SEQ ID NO: 986 - protein, 16 aa, Arabidopsis thaliana
  consensus sequence in NPR1-like C domain of the NPR3 clade
  misc_feature (2)..(3): Xaa can be any naturally occurring amino acid
  misc_feature (4)..(4): Xaa can be Ile, Leu, Val or Met
  misc_feature (6)..(6): Xaa can be Ile, Leu, Val or Met
  misc_feature (7)..(8): Xaa can be any naturally occurring amino acid
  misc_feature (10)..(10): Xaa can be Glu or Gln
  misc_feature (11)..(12): Xaa can be any naturally occurring amino acid
  misc_feature (13)..(13): Xaa can be Ile, Leu, Val or Met
  misc_feature (14)..(14): Xaa can be Arg, Gln or absent
  misc_feature (15)..(15): Xaa can be any naturally occurring amino acid
  misc_feature (16)..(16): Xaa can be Lys or Arg
KXXXCXXXLXXXXXXX

SEQ ID NO: 987 - DNA, 1749 bp, Brachypodium distachyon
  Bradi2g05870.1
atggaggctcccctgaccagccacgtgaccaccgccttctccgactgcgacagcgcgcccatggagatggaggacgacgcggcggcggcggcggcggacgcggccgacgtggaggcgctccgccgcctctccgacaacctggccgccgccttccgctcgccggaccgcttcgccttcctcaccgacgcgcgcctcgtcgcgtgcccgggcgcccccgagctgcgcgtgcaccgctgcgtgctctccgcgcggagccccttcctgcgcgccttcttcgcgcgccgcgccgccgcggagggcggcgtcggcgaccgggtggagctccgggagctgctgggtgacgaggtggaggtcggccatgaggcgctggttctggtgctcgagtacctgtacagcggccgcgtccgcgagccccccaagtcggccttcttctgcgtcgacgaggacggctgcgcgcacgtcgggtgccgcccagccgtctccttcatggcgcaagtcctcttcgccgcctccgtcttccaggtcgctgagctcgccaacctcttccagcggcatctccttgatgtccttgataaggttgaagtggataaccttccattgatcttatctgttgcaagcttatgtagtaaatcttgcatgaaactgcttgagagatgcctagagattgtagttcagtcaaatcttgacatgattactcttgagaaaactgtgcctcaagatgttatgaagcaaattattgattcacggctgagtcttggattagtttcaccggaagacaatggctttcctaacaaacatgtaaggaggatacacagagctcttgattctgatgatgtggagctagtgaggatgttgctcaaggaagggcagactaatcttgatgatgcatttgcattgcactatgctgtagaacattgtgactcaaaaattacgacagaacttctggacatcgcacttgcagatgttaatcatagaaacccaagaggttatactgttcttcacatcgctgctaggcgaagagatcctaaaatcgttgtctctcttttaaccaaaggggctcggccttcggatgttacatctgatggaagaaaagcagttcagatctcaaagagactcacaaaacatggtgattactttggggttactgaagaagggaagccgtctccgaaagataggctatgtattgagatactggagcaagctgaaagaagggatccacaacttggagaagcatcggtttctcttgcaatggctggtgattgtctacgtggaaaattattgtacctcgaaaaccgagttgccttggcgaggatattgtttcctattgaggcaagagtggcaatggacattgctcaagtggatggaactttggaattcacccttggttctagtgcaaatcaacttccagagataccacgggcaaccgttgatctaaatgaaactccttttaaaatgaaggatgaacacttggctcggatgacagccctctccaaaacagttgaactcggtaaacgcttctttccgcgctgttcaaaagtgctggacacgatcatggatgatgaaactgaggctaccgagttggcttccctcggacgggataatacatccacagagaggaagaggagattccatgacctgcaagacgtgcttcagaaggcattcagcgaggacaaggaggagtttgcccggtcggccctttcgtcttcctcatcatcggcgacgtcgatcggaggagtccgccctaggaga

SEQ ID NO: 988 - protein, 583 aa, Brachypodium distachyon
  Bradi2g05870.1 polypeptide
MEAPLTSHVTTAFSDCDSAPMEMEDDAAAAAADAADVEALRRLSDNLAAAFRSPDRFAFLTDARLVACPGAPELRVHRCVLSARSPFLRAFFARRAAAEGGVGDRVELRELLGDEVEVGHEALVLVLEYLYSGRVREPPKSAFFCVDEDGCAHVGCRPAVSFMAQVLFAASVFQVAELANLFQRHLLDVLDKVEVDNLPLILSVASLCSKSCMKLLERCLEIVVQSNLDMITLEKTVPQDVMKQIIDSRLSLGLVSPEDNGFPNKHVRRIHRALDSDDVELVRMLLKEGQTNLDDAFALHYAVEHCDSKITTELLDIALADVNHRNPRGYTVLHIAARRRDPKIVVSLLTKGARPSDVTSDGRKAVQISKRLTKHGDYFGVTEEGKPSPKDRLCIEILEQAERRDPQLGEASVSLAMAGDCLRGKLLYLENRVALARILFPIEARVAMDIAQVDGTLEFTLGSSANQLPEIPRATVDLNETPFKMKDEHLARMTALSKTVELGKRFFPRCSKVLDTIMDDETEATELASLGRDNTSTERKRRFHDLQDVLQKAFSEDKEEFARSALSSSSSSATSIGGVRPRR

SEQ ID NO: 989 - DNA, 1746 bp, Oryza sativa
  LOC_Os01g09800.1
atggagccgccgaccagccacgtcaccaacgcgttctccgactcggacagcgcgtccgtggaggaggggggcgccgacgcggacgccgacgtggaggcgctccgccgcctctccgacaacctcgccgcggcgttccgctcgcccgaggacttcgcgttcctcgccgacgcgcgcatcgccgtcccgggcggcggcggcggcggcggcgacctgctggtgcaccgctgcgtgctctccgcgcggagccccttcctgcgcggcgtcttcgcgcgccgcgccgccgccgccgcaggcggcggcggcgaggatggcggcgagaggctggagctccgggaactcctcggcggcggcggcgaggaggtggaggtcgggtacgaggcgctgcggctggtgctcgactacctctacagcggccgcgtcggcgacctgcccaaggcggcgtgcctctgcgtcgacgaggactgcgcccacgtcgggtgccaccccgccgtcgcgttcatggcgcaggtcctcttcgccgcctccaccttccaggtcgccgagctcaccaacctcttccagcggcgtctccttgatgtccttgataaggttgaggtagataaccttctattgatcttatctgttgccaacttatgcaacaaatcttgcatgaaactgcttgaaagatgccttgatatggtagtccggtcaaaccttgacatgattactcttgagaagtcattgcctccagatgttatcaagcagattattgatgcacgcctaagcctcggattaatttcaccagaaaacaagggatttcctaacaaacatgtgaggaggatacacagagcccttgactctgacgatgtagagctagtcaggatgctgctcactgaaggacagacaaatcttgatgatgcgtttgcactgcactacgccgtcgaacattgtgactccaaaattacaaccgagcttttggatctcgcacttgcagatgttaatcatagaaacccaagaggttatactgttcttcacattgctgcgaggcgaagagagcctaaaatcattgtctcccttttaaccaagggggctcggccagcagatgttacattcgatgggagaaaagcggttcaaatctcaaaaagactaacaaaacaaggggattactttggggttaccgaagaaggaaaaccttctccaaaagataggttatgtattgaaatactggagcaagctgaaagaagggacccacaactcggagaagcatcagtttctcttgcaatggcaggtgagagtctacgaggaaggttgctgtatcttgaaaaccgagttgctttggcgaggattatgtttccgatggaggcaagagtagcaatggatattgctcaagtggatggaactttggaatttaacctgggttctggtgcaaatccacctcctgaaagacaacggacaactgttgatctaaatgaaagtcctttcataatgaaagaagaacacttagctcggatgacggcactctccaaaacagtggagctcgggaaacgctttttcccgcgatgttcgaacgtgctcgacaagatcatggatgatgaaactgatccggtttccctcggaagagacacgtccgcggagaagaggaagaggtttcatgacctgcaggatgttcttcagaaggcattccacgaggacaaggaggagaatgacaggtcggggctctcgtcgtcgtcgtcatcgacatcgatcggggccattcgaccaaggaga

SEQ ID NO: 990 - protein, 582 aa, Oryza sativa
  LOC_Os01g09800.1 polypeptide
MEPPTSHVTNAFSDSDSASVEEGGADADADVEALRRLSDNLAAAFRSPEDFAFLADARIAVPGGGGGGGDLLVHRCVLSARSPFLRGVFARRAAAAAGGGGEDGGERLELRELLGGGGEEVEVGYEALRLVLDYLYSGRVGDLPKAACLCVDEDCAHVGCHPAVAFMAQVLFAASTFQVAELTNLFQRRLLDVLDKVEVDNLLLILSVANLCNKSCMKLLERCLDMVVRSNLDMITLEKSLPPDVIKQIIDARLSLGLISPENKGFPNKHVRRIHRALDSDDVELVRMLLTEGQTNLDDAFALHYAVEHCDSKITTELLDLALADVNHRNPRGYTVLHIAARRREPKIIVSLLTKGARPADVTFDGRKAVQISKRLTKQGDYFGVTEEGKPSPKDRLCIEILEQAERRDPQLGEASVSLAMAGESLRGRLLYLENRVALARIMFPMEARVAMDIAQVDGTLEFNLGSGANPPPERQRTTVDLNESPFIMKEEHLARMTALSKTVELGKRFFPRCSNVLDKIMDDETDPVSLGRDTSAEKRKRFHDLQDVLQKAFHEDKEENDRSGLSSSSSSTSIGAIRPRR

SEQ ID NO: 991 - DNA, 1749 bp, Zea mays
  GRMZM2G077197_T01
atggagcccatggacagccagctcacggctctcgcgctctccgactccgacagcgcctccgtcgagggcgccgcagctgacgcggcggacgccgacctgcaggcgctccgccgcctctccgacaacctcgcggcggcgttccgctccccagacgacttcgccttcctcgccgacgcgcgcatcgtggttcccggcgcgcccgacctccgcgtgcaccgctgcgtgctctgcgcgcgcagccccttcctgcgcgacgcctttgcgcgccgcgccgccagcgccggcgaggaggagaaggacaaggacagttacatgtgcaaggtggagctccgggatctcctcggagacgaggtcgaggtcgggtacgacgcgctgcggctggtgctcgactacctctacagcggccgcgtcgccgccctgcccaaggcggcctgcctctgcgtcgacgaggacgcctgcgcgcacgtcggctgccgccccgccgtcgccttcatggcgcaggtcctcttcgccgcgtccaccttcgacgtcgccgagctcaccaatctcttccagcggcggctccttgatgtccttgataaggttgaagtggacaacctcccattggtcttatctgttgccaacttatgtagcaaatcttgtgtgaaactgcttgagaggtgccttgatgtagtagttcgttcaaatcttgatatgattgctcttgaaaaaaagttgcctccagatgttgtcaaagaaattgttgatgcaagggtaagccttggattagtttcaccggaagacaagggcttccctaacatacatgtaagaagaatacacagagcactggattctgatgacgtggagctagtccggatgctactcaaggaaggaaaaactaatcttgatgatgcatatgcattacactatgccgtcgaacattgcgactcaaagatcacaacagaacttctggatctcgcgcttgcagatgtcaatcataggaacccaagaggttatacggtccttcacattgctgctatgagaagggaacctaaaatcattgtctctcttttgaccaagggagctcggccatcagacctcacatttgatgacagaaaagcagtgcagatctctaaacgacttacaaagcatggggattactttgggcctactgaggacggaaagccttctcctaaagatagattatgtattgaggtactagagcaagctgaaagaagggacccgcaacttggagaagcatcagtttctcttgcgatagaaggagactctgcgcgtgggaggctactctaccttgaaaaccgagttgctctagcaagaatactgtttcctatggaggcaagggtagcaatggacattgctcaagtcgatggaacactggaattcacccttgtttctagtgtgaatctgcctgccgagatacaacggacagttgacctgaacgatactcctttcacaatgaaggaagaacacctggctcggatgagagccctatccaagacagtggaagtcgggaagcgtttcttcccgcggtgttcgaaggtacttgacacgatcatggacgacgaagccgagatggcttccctcgggcgagacacatccgcggagaagaagaggaggttccatgacctgcaagacctggtccagaaggcattcagcgaggacaaggaggagaacgacaggtccgcggcgcggtcaccttcctcctcgtcgacgacgacgacgtcgatcggggccgtccggcctcggagg

SEQ ID NO: 992 - protein, 583 aa, Zea mays
  GRMZM2G077197_T01 polypeptide
MEPMDSQLTALALSDSDSASVEGAAADAADADLQALRRLSDNLAAAFRSPDDFAFLADARIVVPGAPDLRVHRCVLCARSPFLRDAFARRAASAGEEEKDKDSYMCKVELRDLLGDEVEVGYDALRLVLDYLYSGRVAALPKAACLCVDEDACAHVGCRPAVAFMAQVLFAASTFDVAELTNLFQRRLLDVLDKVEVDNLPLVLSVANLCSKSCVKLLERCLDVVVRSNLDMIALEKKLPPDVVKEIVDARVSLGLVSPEDKGFPNIHVRRIHRALDSDDVELVRMLLKEGKTNLDDAYALHYAVEHCDSKITTELLDLALADVNHRNPRGYTVLHIAAMRREPKIIVSLLTKGARPSDLTFDDRKAVQISKRLTKHGDYFGPTEDGKPSPKDRLCIEVLEQAERRDPQLGEASVSLAIEGDSARGRLLYLENRVALARILFPMEARVAMDIAQVDGTLEFTLVSSVNLPAEIQRTVDLNDTPFTMKEEHLARMRALSKTVEVGKRFFPRCSKVLDTIMDDEAEMASLGRDTSAEKKRRFHDLQDLVQKAFSEDKEENDRSAARSPSSSSTTTTSIGAVRPRR

SEQ ID NO: 993 - DNA, 1734 bp, Setaria italica
  Si000814m
atggagcccatggacagccaggtcacagccgtcgcgctctctgactccgatagcgtctccgtcgacggcgccgacgcggcggacgccgacctacaggcgctccgccgcctctccgacaatctcgccgccgcgttccgctcccccgacgacttcgccttcctctccgacgcgcgcatcgcggtgcccggcgcgcccgacctttgcgtgcaccgctgcgtgctctgcgcgcgcagtcccttcctgcgcgccttcttcgcgcgccgaaccgcggccgccggcgccggcgaggagaaggtcaaggacaaagacaaggacaaggacaaggacaaggacaaggacaaggtcgagctccgagagcttctcggcgaggaggtggaggtcggctacgaggcgctgcggctggtgatcgagtacctctacagcggccgcgtcggcgccctgcccaaggcggcgtgtctctgcgtcgacgagggcggttgcgcgcatctcggctgccgccccgccgtcgccttcatggcgcaggtcctcttcgccgcctccaccttcgaggtcgccgagctcaccagcctcttccagcggcagctccttgatgtccttgataaggttgaagtagacaacctcccattgatcctatctgttgcaaacttatgcagcaaatcttgtgtgaaacttctcgagagatgccttgagatagtagttcggtcaaatcttgatatgattactcttgagaaggctttgcctccagatgttgtcaaacaaattgttgatgcaaggctaagtcttgaattagtttcgcctgaagacaagggcttccctaacatacatgtacgaagagtacacagagcgctggattctgatgatgtggagctagtcagaatgctactcaaggaagggaaaactaatcttgatgacgcatatgcattgcactatgctgtagaacattgtgactcaaagatcacaacagagcttctggatctcgcacttgcagatgttaatcataggaacccaagaggttatacagttcttcatattgctgctatgagaatggagcctaaaattattgtctcccttttgaccaagggagctcggccgtcagatctcacatttgatcatagaaaagcagtacagatatctaagcgacttaccaagcatggggattactttgggcctactgaggatggaaaaccttctccaaaagataaattatgtattgagatactagagcaagctgaaagaagggatccgcaacttggagaagcatcagtttctcttgcgatggcaggagactgtctgcgtggaaggttgctctaccttgaaaatcgagttgctttagcgaggatattgttccccatggaggcaagggtagcaatggacattgctcaagtggatggaaccttggaatttgcccttactgttgatctaaatgacactcctttcaaaatgaaggaagaacacttgactcggatgagcgccctctccaaaacagtggaacttgggaagcgcttcttcccacggtgttcaaaagtgctggaccagttcatggacgatgaaaacgagctggcttcccttgggagagacacatccacatccacagagaagaagaggaggttccatgacctgcaagacgtgctccagaaggcattcagcgaggacaaggaggagaatgacaggtcagcccgttcatcttccgtatcatcgaggacgacatcgatcggagccgtccggcccaggaga

SEQ ID NO: 994 - protein, 578 aa, Setaria italica
  Si000814m polypeptide
MEPMDSQVTAVALSDSDSVSVDGADAADADLQALRRLSDNLAAAFRSPDDFAFLSDARIAVPGAPDLCVHRCVLCARSPFLRAFFARRTAAAGAGEEKVKDKDKDKDKDKDKDKVELRELLGEEVEVGYEALRLVIEYLYSGRVGALPKAACLCVDEGGCAHLGCRPAVAFMAQVLFAASTFEVAELTSLFQRQLLDVLDKVEVDNLPLILSVANLCSKSCVKLLERCLEIVVRSNLDMITLEKALPPDVVKQIVDARLSLELVSPEDKGFPNIHVRRVHRALDSDDVELVRMLLKEGKTNLDDAYALHYAVEHCDSKITTELLDLALADVNHRNPRGYTVLHIAAMRMEPKIIVSLLTKGARPSDLTFDHRKAVQISKRLTKHGDYFGPTEDGKPSPKDKLCIEILEQAERRDPQLGEASVSLAMAGDCLRGRLLYLENRVALARILFPMEARVAMDIAQVDGTLEFALTVDLNDTPFKMKEEHLTRMSALSKTVELGKRFFPRCSKVLDQFMDDENELASLGRDTSTSTEKKRRFHDLQDVLQKAFSEDKEENDRSARSSSVSSRTTSIGAVRPRR

SEQ ID NO: 995 - DNA, 1779 bp, Arabidopsis thaliana
  AT1G64280.1
atggacaccaccattgatggattcgccgattcttatgaaatcagcagcactagtttcgtcgctaccgataacaccgactcctctattgtttatctggccgccgaacaagtactcaccggacctgatgtatctgctctgcaattgctctccaacagcttcgaatccgtctttgactcgccggatgatttctacagcgacgctaagcttgttctctccgacggccgggaagtttctttccaccggtgcgttttgtcagcgagaagctctttcttcaagagcgctttagccgccgctaagaaggagaaagactccaacaacaccgccgccgtgaagctcgagcttaaggagattgccaaggattacgaagtcggtttcgattcggttgtgactgttttggcttatgtttacagcagcagagtgagaccgccgcctaaaggagtttctgaatgcgcagacgagaattgctgccacgtggcttgccggccggcggtggatttcatgttggaggttctctatttggctttcatcttcaagatccctgaattaattactctctatcagaggcacttattggacgttgtagacaaagttgttatagaggacacattggttatactcaagcttgctaatatatgtggtaaagcttgtatgaagctattggatagatgtaaagagattattgtcaagtctaatgtagatatggttagtcttgaaaagtcattgccggaagagcttgttaaagagataattgatagacgtaaagagcttggtttggaggtacctaaagtaaagaaacatgtctcgaatgtacataaggcacttgactcggatgatattgagttagtcaagttgcttttgaaagaggatcacaccaatctagatgatgcgtgtgctcttcatttcgctgttgcatattgcaatgtgaagaccgcaacagatcttttaaaacttgatcttgccgatgtcaaccataggaatccgaggggatatacggtgcttcatgttgctgcgatgcggaaggagccacaattgatactatctctattggaaaaaggtgcaagtgcatcagaagcaactttggaaggtagaaccgcactcatgatcgcaaaacaagccactatggcggttgaatgtaataatatcccggagcaatgcaagcattctctcaaaggccgactatgtgtagaaatactagagcaagaagacaaacgagaacaaattcctagagatgttcctccctcttttgcagtggcggccgatgaattgaagatgacgctgctcgatcttgaaaatagagttgcacttgctcaacgtctttttccaacggaagcacaagctgcaatggagatcgccgaaatgaagggaacatgtgagttcatagtgactagcctcgagcctgaccgtctcactggtacgaagagaacatcaccgggtgtaaagatagcacctttcagaatcctagaagagcatcaaagtagactaaaagcgctttctaaaaccgtggaactcgggaaacgattcttcccgcgctgttcggcagtgctcgaccagattatgaactgtgaggacttgactcaactggcttgcggagaagacgacactgctgagaaacgactacaaaagaagcaaaggtacatggaaatacaagagacactaaagaaggcctttagtgaggacaatttggaattaggaaattcgtccctgacagattcgacttcttccacatcgaaatcaaccggtggaaagaggtctaaccgtaaactctctcatcgtcgtcgg

SEQ ID NO: 996 - protein, 593 aa, Arabidopsis thaliana
  AT1G64280.1 polypeptide
MDTTIDGFADSYEISSTSFVATDNTDSSIVYLAAEQVLTGPDVSALQLLSNSFESVFDSPDDFYSDAKLVLSDGREVSFHRCVLSARSSFFKSALAAAKKEKDSNNTAAVKLELKEIAKDYEVGFDSVVTVLAYVYSSRVRPPPKGVSECADENCCHVACRPAVDFMLEVLYLAFIFKIPELITLYQRHLLDVVDKVVIEDTLVILKLANICGKACMKLLDRCKEIIVKSNVDMVSLEKSLPEELVKEIIDRRKELGLEVPKVKKHVSNVHKALDSDDIELVKLLLKEDHTNLDDACALHFAVAYCNVKTATDLLKLDLADVNHRNPRGYTVLHVAAMRKEPQLILSLLEKGASASEATLEGRTALMIAKQATMAVECNNIPEQCKHSLKGRLCVEILEQEDKREQIPRDVPPSFAVAADELKMTLLDLENRVALAQRLFPTEAQAAMEIAEMKGTCEFIVTSLEPDRLTGTKRTSPGVKIAPFRILEEHQSRLKALSKTVELGKRFFPRCSAVLDQIMNCEDLTQLACGEDDTAEKRLQKKQRYMEIQETLKKAFSEDNLELGNSSLTDSTSSTSKSTGGKRSNRKLSHRRR

SEQ ID NO: 997 - DNA, 1800 bp, Arabidopsis thaliana
  AT4G26120.1
atggccaccaccaccaccaccaccaccgctagattctctgattcatacgagttcagcaacacaagcggcaatagcttcttcgccgccgagtcatctcttgattatccgacggaatttctcacgccaccggaggtatcagctcttaaacttctgtctaactgcctcgagtctgttttcgactcgccggagacgttctacagcgatgctaagctagttctcgccggcggccgggaagtttcttttcaccgttgtattctttccgcgagaattcctgtcttcaaaagcgctttagccaccgtgaaggaacaaaaatcctccaccaccgtgaagctccagctgaaagagatcgccagagattacgaagtcggctttgactcggttgtggcggttttggcgtatgtttacagcggcagagtgaggtccccgccgaagggagcttctgcttgcgtagacgacgattgttgccacgtggcttgccggtcaaaggtggatttcatggtggaggttctttatctgtctttcgttttccagattcaagaattagttactctgtatgagaggcagttcttggaaattgtagacaaagttgtagtcgaagacatcttggttatattcaagcttgatactctatgtggtacaacatacaagaagcttttggatagatgcatagaaattatcgtgaagtctgatatagaactagttagtcttgagaagtctttacctcaacacattttcaagcaaatcatagacatccgcgaagcgctctgtctagagccacctaaactagaaaggcatgtcaagaacatatacaaggcgctagactcagatgatgttgagcttgtcaagatgcttttgctagaaggacacaccaatctcgatgaggcgtatgctcttcattttgctatcgctcactgcgctgtgaagaccgcgtatgatctcctcgagcttgagcttgcggatgttaaccttagaaatccgaggggatacactgtgcttcatgttgctgcgatgcggaaggagccgaagttgataatatctttgttaatgaaaggggcaaatattttagacacaacattggatggtagaaccgctttagtgattgtaaaacgactcactaaagcggatgactacaaaactagtacggaggacggtacgccttctctgaaaggcggattatgcatagaggtacttgagcatgaacaaaaactagaatatttgtcgcctatagaggcttcactttctcttccagtaactccagaggagttgaggatgaggttgctctattatgaaaaccgagttgcacttgctcgacttctctttccagtggaaactgaaactgtacagggtattgccaaattggaggaaacatgcgagtttacagcttctagtctcgagcctgatcatcacattggtgaaaagcggacatcactagacctaaatatggcgccgttccaaatccatgagaagcatttgagtagactaagagcactttgtaaaaccgtggaactggggaaacgctacttcaaacgatgttcgcttgatcactttatggatactgaggacttgaatcatcttgctagcgtagaagaagatactcctgagaaacggctacaaaagaagcaaaggtacatggaactacaagagactctgatgaagacctttagtgaggacaaggaggaatgtggaaagtcttccacaccgaaaccaacctctgcggtgaggtctaatagaaaactctctcaccggcgcctaaaagtggacaaacgggattttttgaaacgaccttacgggaacggggat

SEQ ID NO: 998 - protein, 600 aa, Arabidopsis thaliana
  AT4G26120.1 polypeptide
MATTTTTTTARFSDSYEFSNTSGNSFFAAESSLDYPTEFLTPPEVSALKLLSNCLESVFDSPETFYSDAKLVLAGGREVSFHRCILSARIPVFKSALATVKEQKSSTTVKLQLKEIARDYEVGFDSVVAVLAYVYSGRVRSPPKGASACVDDDCCHVACRSKVDFMVEVLYLSFVFQIQELVTLYERQFLEIVDKVVVEDILVIFKLDTLCGTTYKKLLDRCIEIIVKSDIELVSLEKSLPQHIFKQIIDIREALCLEPPKLERHVKNIYKALDSDDVELVKMLLLEGHTNLDEAYALHFAIAHCAVKTAYDLLELELADVNLRNPRGYTVLHVAAMRKEPKLIISLLMKGANILDTTLDGRTALVIVKRLTKADDYKTSTEDGTPSLKGGLCIEVLEHEQKLEYLSPIEASLSLPVTPEELRMRLLYYENRVALARLLFPVETETVQGIAKLEETCEFTASSLEPDHHIGEKRTSLDLNMAPFQIHEKHLSRLRALCKTVELGKRYFKRCSLDHFMDTEDLNHLASVEEDTPEKRLQKKQRYMELQETLMKTFSEDKEECGKSSTPKPTSAVRSNRKLSHRRLKVDKRDFLKRPYGNGD

SEQ ID NO: 999 - DNA, 1755 bp, Citrus clementina
  clementine0.9_005813m
atggataatagaaatgggttctcggattcaaacgagatcagtaacaacagccgcaccagctgtgtagctgcagcagcaaatactgagtctttctattcatcagaacctgtaaactctgacatcacagctcttcgaattctctcaaagaccctcgaaacaatctttgaatctcaggattttgactactttacagatgccaagatcgtgctttcaaccggccgcgaagtcccggtccaccgctgcatactttcttccagaagtggttttttcaagaatgtatttgctgggactggaaaacagagaggacccaagtttgagctcaaggagttagtgagggattatgaagttgggtttgatccgcttgttgcggttttggcttacttgtattgtgggaaagtgaggcctttccctataggcgtttgtgtttgtgtggatgatgatgcctgctcgcatgttgcttgtaggccggctgttgattttatggtggaggttctttatgtgtcttttgcttttcaggttccagagttggtggctctttatcagaggcacctcctagacattctggacaaggttgtggcagatgacattttggtagttttatctgtcgcacatatgtgcggtaaagcttgtgagaagttgttagaaaggtgcatagagattactgtcaaatcagatattgatattgtaactcttgataagaccttgccacaacacattgtgaaacaaatcatagacttgcgtgtggaactcagcttacatagatctgaatcctgcggttttccagataaacatacaaagagaatacatcgagcactagactcagatgatgttgaattagtcagaatgctattgaaagaggctcatactaatctagatgacgcacatgcacttcactatgccgtggcatattgtgatgcaaagaccacaactgagcttcttgatcttggacttgctgatgtcaaccatagaaattcaaggggctatactgtgctgcatgttgctgcaatgaggaaggagcctaagataatagtgtctcttttaacaaagggagctcggccatcagatcttacattggatggtagaaaagcacttcagatctcaaagcggctcactaaggctgcagattactatattcccactgaggaaggaaaaacaaccccaaaagatcggttatgcatagagatattggaacaagctgaaagaagagatcccttgctcagagaagcttctcattcttttgctatggctggtgatgatcttcggatgaaactgctgtaccttgaaaacagagttggactggctaaacttctgtttcctatggaagcaaaagtcataatggatattgtccatcttgatggcactttggagtttgcattagatggcatcaaaactaagaaaatggccggtgcccagaggacaactgtggacttgaatgaagcacctttcaaaatgcaagaggagcatctaaacagaatgaaagcactctgtagaactgtggagctggggaaacgttttttccctcgttgttcagaagtacttaacaagataatggatgccgatgacttaaatcagctagcatgtccggggaacgatactccagaagagcgactcctgaaacgaataaggtacatggaacttcaagaagttgtaagtaaggcgtttaatgaggataaagaagagtttgataggtctgctatatcatcttcttcatcatcaaaatcagttgtgaggcctcgtgggggtaaaagaactcac

SEQ ID NO: 1000 - protein, 585 aa, Citrus clementina
  clementine0.9_005813m polypeptide
MDNRNGFSDSNEISNNSRTSCVAAAANTESFYSSEPVNSDITALRILSKTLETIFESQDFDYFTDAKIVLSTGREVPVHRCILSSRSGFFKNVFAGTGKQRGPKFELKELVRDYEVGFDPLVAVLAYLYCGKVRPFPIGVCVCVDDDACSHVACRPAVDFMVEVLYVSFAFQVPELVALYQRHLLDILDKVVADDILVVLSVAHMCGKACEKLLERCIEITVKSDIDIVTLDKTLPQHIVKQIIDLRVELSLHRSESCGFPDKHTKRIHRALDSDDVELVRMLLKEAHTNLDDAHALHYAVAYCDAKTTTELLDLGLADVNHRNSRGYTVLHVAAMRKEPKIIVSLLTKGARPSDLTLDGRKALQISKRLTKAADYYIPTEEGKTTPKDRLCIEILEQAERRDPLLREASHSFAMAGDDLRMKLLYLENRVGLAKLLFPMEAKVIMDIVHLDGTLEFALDGIKTKKMAGAQRTTVDLNEAPFKMQEEHLNRMKALCRTVELGKRFFPRCSEVLNKIMDADDLNQLACPGNDTPEERLLKRIRYMELQEVVSKAFNEDKEEFDRSAISSSSSSKSVVRPRGGKRTH

SEQ ID NO: 1001 - DNA, 1722 bp, Citrus clementina
  clementine0.9_006073m
atggataatagaaatgggttctcggattcaaacgagatcagtaacaacagccgcaccagctgtgtagctgcagcagcaaatactgagtctttctattcatcagaacctgtaaactctgacatcacagctcttcgaattctctcaaagaccctcgaaacaatctttgaatctcaggattttgactactttacagatgccaagatcgtgctttcaaccggccgcgaagtcccggtccaccgctgcatactttcttccagaagtggttttttcaagaatgtatttgctgggactggaaaacagagaggacccaagtttgagctcaaggagttagtgagggattatgaagttgggtttgatccgcttgttgcggttttggcttacttgtattgtgggaaagtgaggcctttccctataggcgtttgtgtttgtgtggatgatgatgcctgctcgcatgttgcttgtaggccggctgttgattttatggtggaggttctttatgtgtcttttgcttttcaggttccagagttggtggctctttatcagaggcacctcctagacattctggacaaggttgtggcagatgacattttggtagttttatctgtcgcacatatgtgcggtaaagcttgtgagaagttgttagaaaggtgcatagagattactgtcaaatcagatattgatattgtaactcttgataagaccttgccacaacacattgtgaaacaaatcatagacttgcgtgtggaactcagcttacatagatctgaatcctgcggttttccagataaacatacaaagagaatacatcgagcactagactcagatgatgttgaattagtcagaatgctattgaaagaggctcatactaatctagatgacgcacatgcacttcactatgccgtggcatattgtgatgcaaagaccacaactgagcttcttgatcttggacttgctgatgtcaaccatagaaattcaaggggctatactgtgctgcatgttgctgcaatgaggaaggagcctaagataatagtgtctcttttaacaaagggagctcggccatcagatcttacattggatggtagaaaagcacttcagatctcaaagcggctcactaaggctgcagattactatattcccactgaggaaggaaaaacaaccccaaaagatcggttatgcatagagatattggaacaagctgaaagaagagatcccttgctcagagaagcttctcattcttttgctatggctggtgatgatcttcggatgaaactgctgtaccttgaaaacagagcaaaagtcataatggatattgtccatcttgatggcactttggagtttgcattagatggcatcaaaactaagaaaatggccggtgcccagaggacaactgtggacttgaatgaagcacctttcaaaatgcaagaggagcatctaaacagaatgaaagcactctgtagaactgtggagctggggaaacgttttttccctcgttgttcagaagtacttaacaagataatggatgccgatgacttaaatcagctagcatgtccggggaacgatactccagaagagcgactcctgaaacgaataaggtacatggaacttcaagaagttgtaagtaaggcgtttaatgaggataaagaagagtttgataggtctgctatatcatcttcttcatcatcaaaatcagttgtgaggcctcgtgggggtaaaagaactcac

SEQ ID NO: 1002 - protein, 574 aa, Citrus clementina
  clementine0.9_006073m polypeptide
MDNRNGFSDSNEISNNSRTSCVAAAANTESFYSSEPVNSDITALRILSKTLETIFESQDFDYFTDAKIVLSTGREVPVHRCILSSRSGFFKNVFAGTGKQRGPKFELKELVRDYEVGFDPLVAVLAYLYCGKVRPFPIGVCVCVDDDACSHVACRPAVDFMVEVLYVSFAFQVPELVALYQRHLLDILDKVVADDILVVLSVAHMCGKACEKLLERCIEITVKSDIDIVTLDKTLPQHIVKQIIDLRVELSLHRSESCGFPDKHTKRIHRALDSDDVELVRMLLKEAHTNLDDAHALHYAVAYCDAKTTTELLDLGLADVNHRNSRGYTVLHVAAMRKEPKIIVSLLTKGARPSDLTLDGRKALQISKRLTKAADYYIPTEEGKTTPKDRLCIEILEQAERRDPLLREASHSFAMAGDDLRMKLLYLENRAKVIMDIVHLDGTLEFALDGIKTKKMAGAQRTTVDLNEAPFKMQEEHLNRMKALCRTVELGKRFFPRCSEVLNKIMDADDLNQLACPGNDTPEERLLKRIRYMELQEVVSKAFNEDKEEFDRSAISSSSSSKSVVRPRGGKRTH

SEQ ID NO: 1003 - DNA, 1842 bp, Eucalyptus grandis
  Eucgr.C00872.1
atgccctcgccgccgccgccgccgctcgccccgctccgcccgcgtgcttttgctcccatggacgccgggaggtccgccttatcggactccaacgagatcatcagcaacagcagcagcatctactgcgctccgaccgccaacacctcctccctctcctcctcccgcgcggcggccccggccgacggggcctccctcgtccgcctctccgaccacctcgagtccatcttcgccgccgagcacggcggcggcggcgacttcgacttcttcgccgacgccaagattgccctcgccgatggccgccaggtgcccgtccaccgctgcatcctctccgggaggagcgggttctttcggggcgcgttcacccgaggggcgaccaagctggaggtcaaggagctggggaaggacttcgagatcgggcacgacgcgctcatggcggtcctagggtacctgtacagcggcaaggtgaagccgccgccgccggccgcccgcgagtgcgtggacgaggagtgcccgcacgcggcatgtcggcccgccgtggatttcctgattcaggtgctctacgcggctttcactttccagatttctgagctggtgggtctgtaccagatggacctgctagacattcttgacaaggttgccatagatgatctgctggtagttctatctgttgcaaatatgtgcagtaatgcgtgtgagggtttgtcagctcgttgcattgagattgttgttaaatcgaatgttgatgttgttaccctagacagagctttgccccattttattgttaagcagattgtggatgccagaatggaacttggcttgaataggccaggatgtgacagctttcctgataagcacgtgaagagaatacacagggctttggattcggatgatgttgagctagtcagaatgctacttagggaggcacatactactctcgatcatgcatgtgcactccattatgcagttgcttactgtgatgccaagactaccaccgaacttcttgatcttggtattgctgatgttaatgaaagaaatcccagaggctataccgttctgcatgttgcagcattgaggaaagagcccaagattattgtgtctcttttagtaaaaggagcccgggcatccgacctcactttggatggtagaaaagcacttcagatatctaagaggctcactagggctgtggattactataaatcaactgaggaaggaaaagctacttccgaggagcgactgtgtgtggagatattggagcaagctgaaagaagagatcctttactaggagaagctgctctttctcttgctatagcaggggacgatctgcgcaagaaattgttatacctggaaaatagagttgcattggctaagctcctctttccaatagaagctaaagtggcaatggatattgctcaagtagatgaaacttctgagtatcctttggtaagcatccagaatttggctcgtaaacaaggggcaaatgtggatttaaatgaagcccctttcaaaatccaagaggagcatctgaataggatgagagcactctccaaaacagtggaacttggaaagcgcttctttcctcgatgctcaagcgtaatcaataagatcatcgataccggtgacttgtcatggctgggaactgttggtgatgacactccagaggaacaacttcgtaagaagcaaaggcatatggaagttgaagaacagatgactgaagcttatactcaagacaaagaggagactgataagtctagtatattgtcttcttcatcgtcgacttcaatgagtttccttaagcctaatggtaaattaacgacaagtgaccagcagcggcactgcgagatt

SEQ ID NO: 1004 - protein, 614 aa, Eucalyptus grandis
  Eucgr.C00872.1 polypeptide
MPSPPPPPLAPLRPRAFAPMDAGRSALSDSNEIISNSSSIYCAPTANTSSLSSSRAAAPADGASLVRLSDHLESIFAAEHGGGGDFDFFADAKIALADGRQVPVHRCILSGRSGFFRGAFTRGATKLEVKELGKDFEIGHDALMAVLGYLYSGKVKPPPPAARECVDEECPHAACRPAVDFLIQVLYAAFTFQISELVGLYQMDLLDILDKVAIDDLLVVLSVANMCSNACEGLSARCIEIVVKSNVDVVTLDRALPHFIVKQIVDARMELGLNRPGCDSFPDKHVKRIHRALDSDDVELVRMLLREAHTTLDHACALHYAVAYCDAKTTTELLDLGIADVNERNPRGYTVLHVAALRKEPKIIVSLLVKGARASDLTLDGRKALQISKRLTRAVDYYKSTEEGKATSEERLCVEILEQAERRDPLLGEAALSLAIAGDDLRKKLLYLENRVALAKLLFPIEAKVAMDIAQVDETSEYPLVSIQNLARKQGANVDLNEAPFKIQEEHLNRMRALSKTVELGKRFFPRCSSVINKIIDTGDLSWLGTVGDDTPEEQLRKKQRHMEVEEQMTEAYTQDKEETDKSSILSSSSSTSMSFLKPNGKLTTSDQQRHCEI

SEQ ID NO: 1005 - DNA, 1728 bp, Solanum lycopersicum
  Solyc07g040690.2.1
atggatagtagaactgctttttcggattccaatgatattagtggaagcagtagtatatgctgcatgaacgaatcggaaacttcactggcagacgtcaattccctcaaacgtctatcagaaacactagagtctatcttcgatgcgtctgcgccggatttcgacttcttcgctgatgctaagcttctggctccaggcggtaaggaaattccggtgcatcggtgcattttgtcggcgaggagtcctttttttaagaatgtattctgtgggaaagatagcaacacgaagctggaactcaaagagctgatgaaagagtatgaggtgagttttgatgccgtggtcagtgtgctcgcctatttgtatagtggaaaagttaggcctgcatctaaagatgtgtgtgtttgtgtggacaatgagtgcttgcatgtagcttgtaggccagctgtggccttcatggttcaggttttgtacgcatcctttacctttcagatctctcaattggtcgacaagtttcagagacacctattggatattcttgacaaagctgtagcagatgatgtaatgatggttttatccgttgcaaacatttgcggtaaagcatgtgaaagattactttcaagatgcattgatattattgtcaagtctaatgttgatatcataacccttgataagtccttgcctcatgacattgtaaaacaaatcactgattcacgtgctgaacttggtctgcaagggcctgaaagcaatggttttcctgataaacatgttaagaggatacatagagcattggactctgatgatgttgaattactaaggatgttgcttaaagaggggcatactactcttgatgatgcatatgctctccactatgctgtagcatattgcgatgcaaagactacagcagaacttttagatctttcacttgctgatgttaatcatcaaaatcctagaggacacacggtacttcatgttgctgccatgaggaaagaacctaaaattatagtgtcccttttaaccaaaggagctagaccttctgatctgacatccgatggcaaaaaagcacttcaaattgctaagaggctcactaggcttgtagattttaccaagtctacagaggaaggaaaatctgctccaaaggatcggttatgcattgagattctggagcaagcagaaagaagagatccactactaggagaagcttcattatctcttgctatggcaggcgatgatttgcgtatgaagctgttataccttgaaaatagagttggtctggctaaactcctttttcccatggaagcaaaagttgcaatggacattgcacaagttgatggcacgtctgaattacccctggctagcatgaggaagaagatagctgatgcacagaggacaacagtggatttgaacgaggctcctttcaagatgaaagaggagcacttgaatcggcttagggctctctctagaactgtggaacttggaaaacggttctttccacgttgttcagaagttctaaataagatcatggatgctgatgacttgtctgagatagcttacatggggaatgatacagtagaagagcgtcaactgaagaagcaaaggtacatggaacttcaagaaattttgtctaaagcattcacggaggataaagaagaatttgctaagactaacatgtcctcatcttgttcctctacatctaagggagtagataagcccaataatctcccatttaggaaa

SEQ ID NO: 1006 - protein, 576 aa, Solanum lycopersicum
  Solyc07g040690.2.1 polypeptide
MDSRTAFSDSNDISGSSSICCMNESETSLADVNSLKRLSETLESIFDASAPDFDFFADAKLLAPGGKEIPVHRCILSARSPFFKNVFCGKDSNTKLELKELMKEYEVSFDAVVSVLAYLYSGKVRPASKDVCVCVDNECLHVACRPAVAFMVQVLYASFTFQISQLVDKFQRHLLDILDKAVADDVMMVLSVANICGKACERLLSRCIDIIVKSNVDIITLDKSLPHDIVKQITDSRAELGLQGPESNGFPDKHVKRIHRALDSDDVELLRMLLKEGHTTLDDAYALHYAVAYCDAKTTAELLDLSLADVNHQNPRGHTVLHVAAMRKEPKIIVSLLTKGARPSDLTSDGKKALQIAKRLTRLVDFTKSTEEGKSAPKDRLCIEILEQAERRDPLLGEASLSLAMAGDDLRMKLLYLENRVGLAKLLFPMEAKVAMDIAQVDGTSELPLASMRKKIADAQRTTVDLNEAPFKMKEEHLNRLRALSRTVELGKRFFPRCSEVLNKIMDADDLSEIAYMGNDTVEERQLKKQRYMELQEILSKAFTEDKEEFAKTNMSSSCSSTSKGVDKPNNLPFRK

SEQ ID NO: 1007 - DNA, 1713 bp, Glycine max
  Glyma09g07440.1
atgaacttcagaagcggctcctcggattcaaaggacgccagtaacagcagcaccggcgaggcctatttgagcggcgtttcggacgtcatcacgccgctgaggcgcctctcggagcagctcgggtcaatattagatggcgggggggttgactttttctccgacgccaagatcgtggccggagacggccgggaagtggcggtgaaccggtgcattctggcggccaggagcggcttcttcaagcatgtcttcgccggtggtggcggctgcgtgctccggctgaaggaagtggccaaggactacaacgtggggttggaggcgcttgggattgttttggcttatttgtatagtggaagagtgaagcctttgcctcaaggtggtgtttgtgtttgtgtggatgatgtgtgttcacattttgggtgtaggcctgctattgatttcttgcttcagcttctctatgcatcctccacttttcagctcaatgaagatcataacatcttgataatcctattcgtaccagataagattattggacatctactagacattcttgaaaaggtggcaatagatgatattttggtggttctatcggtcgcaaatatatgtggcatagtgtgtgaaagactactagcaaggtgcactgagatgatacttaaatctgatgctgatatcaccactcttgaaaaggcactgcctcaacatttggtgaagcaaatcacagataaacgaatagaactggacctgtacatgcccgaaaacttcaattttcctgacaaacatgtcaacagaatacacagggcactggattcggacgatgtggaactggtaagattgcttttgaaagagggacacacaactcttgatgatgcttatgcactccactatgctgttgcatactgtgatgtgaagaccaccactgagcttcttgatcttggtcttgctgatgtgaaccacaaaaactataggggctatagtgtgctgcatgttgctgcaatgaggaaggagcctaagattatagtttctctcttgactaagggggcacagccttctgatctcactttggatggaagaaaagcccttcagatttcgaaacgtctcaccaaagctgtggattattataagtccacagaggaaggaaaagtttcatgcagtgacaggttgtgcatagagatattggagcaagctgagagaagggagcctttacttggagaggcatctctttctcttgctatggcaggggatgatttgcgcatgaaactgttgtacctagaaaatagagttggactggcgaaagtgttgtttcccatggaagcaaaggttattatggatatttctcaaattgatggcacatctgagtttccatcaacagacatgtactgtccaaatattagtgatcaccagaggacaactgtggacttaaacgatgcacctttcagaatgaaggaagaacatctagttaggttgagagcactgtctagaactgtggagttggggaaacgcttcttccctcgatgctcagaagtgttgaacaagatcatggatgctgatgacctaactcagcttacatgtatgggtgatgacagtcccgaagatcgactaaggaagcgaagaaggtatgtggagctccaagaagttctgaataaggtcttcaatgaggacaaggaggagtttgataggtctgccatgtcatcatcatcctcttctacatcaattgga

SEQ ID NO: 1008 - protein, 572 aa, Glycine max
  Glyma09g07440.1 polypeptide
MNFRSGSSDSKDASNSSTGEAYLSGVSDVITPLRRLSEQLGSILDGGGVDFFSDAKIVAGDGREVAVNRCILAARSGFFKHVFAGGGGCVLRLKEVAKDYNVGLEALGIVLAYLYSGRVKPLPQGGVCVCVDDVCSHFGCRPAIDFLLQLLYASSTFQLNEDHNILIILFVPDKIIGHLLDILEKVAIDDILVVLSVANICGIVCERLLARCTEMILKSDADITTLEKALPQHLVKQITDKRIELDLYMPENFNFPDKHVNRIHRALDSDDVELVRLLLKEGHTTLDDAYALHYAVAYCDVKTTTELLDLGLADVNHKNYRGYSVLHVAAMRKEPKIIVSLLTKGAQPSDLTLDGRKALQISKRLTKAVDYYKSTEEGKVSCSDRLCIEILEQAERREPLLGEASLSLAMAGDDLRMKLLYLENRVGLAKVLFPMEAKVIMDISQIDGTSEFPSTDMYCPNISDHQRTTVDLNDAPFRMKEEHLVRLRALSRTVELGKRFFPRCSEVLNKIMDADDLTQLTCMGDDSPEDRLRKRRRYVELQEVLNKVFNEDKEEFDRSAMSSSSSSTSIGV

SEQ ID NO: 1009 - DNA, 1767 bp, Populus trichocarpa
  POPTR_0006s15040.1
atggataataggattggtttctctgattctaacgagatcagcaatggaagtagcacttgctgcatagaaactccctcaacttcaaagccttttacaaacccagaaattgtagctcttcaacaactatcaggaaaccttgaagccatctttgactcccaagattttgactactttgctgatgccaaaatcacaagctccaattacaaccgtgaagtcccagttcacaggtgcattttatctgcgagaagtccttttttcaagagtgttttctcgagtcctgtggctaaagacagaagtggggtagcaaagtttgaattgaaggaattggctaaggactatgatgttggatttgattcacttatgacagtcttgggttatttatattgtgggaaagtgaggccttggcctaaagatgtttgtgcttgtgtggatgatgattgttcccatattgcttgccggcctgcagttgatctcctgactgaggttctttatgcctcttttacattccaggttaatgagttggtggctctttatcagaggcacctattagacattcttgacaaggtttcaactgatgacatcttggtgattctagcagttgcaaacatatgtggtgaagcttgtgagagattgctaacaagatgcgttgagattattgtgaaatcaaatgttgatattgttactctggataaagccttgccgcaatacattgtgaagaaaatcatggattctcgtttggaacttggtttgaatgtgcctgagaacagtaacttactagataaacatgtaaagagaatacatcgggctctggactcggatgatgttgagctagttagaatgctactgaaagaggcacatactaatctagatgatgcgcatgcactccactatgctgtttcatactgtgatgcaaagactacaactgagattcttgatcttggattagctgatgttaactgcagaaattcaaggggttacaccgtgctgcatgtcgctgcaatgcggaaagatcctaagattatagtatctctcttaacgaagggagctcggctgtcagatcttactttagatggtaggaaggctctgcagatatcaaaacgacttacaagggccatggattatcataagtcaacagaggaaggaaaagcttctcccaaggagcgcttgtgtatagaaatattggaacaagcagaaaggagggatccattacttggagaggcttctctttctcttgctatggctggtgatgacctgcgaatgaaattgttgtacctcgaaaatagagttggactggcaaaactcctttttcccatggaagcaaaagttgcaatggatattgctcaggttgatggtacttctgagtttccattagctggcatcaggcccagcatcttgtctggggcacaaagaggagctgtggacttgaacgaggcacctttcagaatgcacgaggagcatctaaataggatgagagcactctctagaacagtggaacttgggaaacggtttttcccacgttgctcagacgtactcaacaagatcatggatgctgatgacctatcacagatagcttatttagggaatgaaacttcagaggaacgacttgtgaagagacagagacaccttgaactccaggatgctctaagcaaggcattcaatgaagataaacaagagttcgacaggtctgtcatatcatcttcatcatccaccaagtcaattggcacggcgaggtctaatgggaagcttattgacatgggtggtggtcat

SEQ ID NO: 1010 - protein, 589 aa, Populus trichocarpa
  POPTR_0006s15040.1 polypeptide
MDNRIGFSDSNEISNGSSTCCIETPSTSKPFTNPEIVALQQLSGNLEAIFDSQDFDYFADAKITSSNYNREVPVHRCILSARSPFFKSVFSSPVAKDRSGVAKFELKELAKDYDVGFDSLMTVLGYLYCGKVRPWPKDVCACVDDDCSHIACRPAVDLLTEVLYASFTFQVNELVALYQRHLLDILDKVSTDDILVILAVANICGEACERLLTRCVEIIVKSNVDIVTLDKALPQYIVKKIMDSRLELGLNVPENSNLLDKHVKRIHRALDSDDVELVRMLLKEAHTNLDDAHALHYAVSYCDAKTTTEILDLGLADVNCRNSRGYTVLHVAAMRKDPKIIVSLLTKGARLSDLTLDGRKALQISKRLTRAMDYHKSTEEGKASPKERLCIEILEQAERRDPLLGEASLSLAMAGDDLRMKLLYLENRVGLAKLLFPMEAKVAMDIAQVDGTSEFPLAGIRPSILSGAQRGAVDLNEAPFRMHEEHLNRMRALSRTVELGKRFFPRCSDVLNKIMDADDLSQIAYLGNETSEERLVKRQRHLELQDALSKAFNEDKQEFDRSVISSSSSTKSIGTARSNGKLIDMGGGH

SEQ ID NO: 1011 - DNA, 1752 bp, Vitis vinifera
  GSVIVT01015181001
atggactacagagctgctctctccgattccaacgacttcagtggcagtagcagcatctgctgcatcgcagccaccaccgaatccctttcctcagaggtttctccgccggacatctcggctctcaggcgcctttcggagaatctcgagtcggtgttcgagtcccccgagtttgacttcttcacagacgccaggatcgtggtcgccggaggccgggaggtgccggtgcaccggtgcattcttgcggcgaggagcgtgtttttcaaggccgtgttggcgggggcgaggaaggagaaggaggcgaagttcgagctgaaggatttggcgaaggaattcgatgttgggtacgactcgctcgtggcggttttggggtatttgtatagtgggagagttggggcgttgccaaaaggcgtttgtgcgtgcgttgatgatgattgcccccactccgcttgtaggcccgctgtggatttcatggtggaggtgctctatgcttctttcgcttttcagatctctgaattggtcggcctttatcagagacgcctgatggacattcttgacaaggttgcttcagatgacattttagtgattctatcagttgctaatctgtgtggtaaagcatgtgatagattgttagcgaggtgtattgacattatcatcaaatctgatgtggatgtcgtgactctggagagggccttgccccaagaaatggtgaaacagattgtggattcgcgattggagcttggctttgaggagcctgaaagcaccaattttcctgacaaacatgtgaagaggatacaccgggctctggattcagatgatgttgaattggtgaggatgctactgaaagagggacatactactctagatgatgcatatgcccttcactatgctgtggcatttggtgatgcaaagaccacaaccgagcttcttgatcttggacttgctgatgttaaccataaaaatcataggggctatactgtgctacacattgctgcaatgcggaaagagcccaagattatagtatcccttcttactaagggagctcggccaactgatatcacgccagacggtagaaatgcactgcaaatagcaaagaggctcaccagggctgtggattaccataagtctaccgaggaaggaaaaccttctcccaaggatcagttgtgcgtagaggtattggagcaagcggaaagacgagatccattgataggggaggcttcgttttctcttgctatagcaggcgatgatctgcgaatgaagctgttgtacctcgaaaatagagttggactagcaaaacttctattccccatggaagctaaagtggcaatggatattgcacaagtggatggcacttctgagtttacactcactgcaatcaggcctaggaatttggctgatgcccagaggacaactgtggacttaaacgaggcgcctttcagaattaaagaggagcacctaaataggctaagagcactgtccaaaactgtggaccttgggaaacgctttttccctagatgctcagaagtactcaacaagatcatggatgccgatgacttatcagatttggcatacctgggcaacggcactacagaggagcgacttctgaagaagaggaggtacaaggaactccaggaccaactgtgcaaggcattcaatgaagacaaagaggagaatgataagtctaggatatcatcctcatcatcatccacatctctagggtttggaaggaataacagtagactctcttgcaagaag

SEQ ID NO: 1012 - protein, 584 aa, Vitis vinifera
  GSVIVT01015181001 polypeptide
MDYRAALSDSNDFSGSSSICCIAATTESLSSEVSPPDISALRRLSENLESVFESPEFDFFTDARIVVAGGREVPVHRCILAARSVFFKAVLAGARKEKEAKFELKDLAKEFDVGYDSLVAVLGYLYSGRVGALPKGVCACVDDDCPHSACRPAVDFMVEVLYASFAFQISELVGLYQRRLMDILDKVASDDILVILSVANLCGKACDRLLARCIDIIIKSDVDVVTLERALPQEMVKQIVDSRLELGFEEPESTNFPDKHVKRIHRALDSDDVELVRMLLKEGHTTLDDAYALHYAVAFGDAKTTTELLDLGLADVNHKNHRGYTVLHIAAMRKEPKIIVSLLTKGARPTDITPDGRNALQIAKRLTRAVDYHKSTEEGKPSPKDQLCVEVLEQAERRDPLIGEASFSLAIAGDDLRMKLLYLENRVGLAKLLFPMEAKVAMDIAQVDGTSEFTLTAIRPRNLADAQRTTVDLNEAPFRIKEEHLNRLRALSKTVDLGKRFFPRCSEVLNKIMDADDLSDLAYLGNGTTEERLLKKRRYKELQDQLCKAFNEDKEENDKSRISSSSSSTSLGFGRNNSRLSCKK

SEQ ID NO: 1013 - DNA, 2073 bp, Eucalyptus grandis
  Eucgr.C03423.1
atggatggagctaagtgtgacgggttggcgaacaagagagaccaaaagaatgagaaagcgagtgtcaagcaagagagagtcgcaattcgagacgacgctctctctctctctctctctctctctcttctccctcgtgccgccattcgaagcggcgctagccggctctgtttcttcttccgcgcgaccgactcttctcgcgccgccgtgcgtgcgtgcgtgcgtgcgtgctcgcgtttcgcgtgggggggtggcatggactacggagcggccgcgctctcggattcgaacgacgccagctacagcagcggcgtgtgctccacgctgacctgcgtggaggctccttcctcctcctactcccccgacgccgcggcggcggcggcggaggcggcggcggaggcgcaggccctgaggaggctctccgacagcctcgagtcgatcttcgagctcccccgcgccggctccggcttctcgttctccgacgccacgatcgtcgccgccgacggccgcgaggtccccgtccaccggtgcgtcctcgccgtgcggagcccgttcttcggggccaagttctcggggagccagagcggggtgaggctcgaattcaaggagctggccgaggatttcggggtcggggtcggggtcggggtcggggccgaagcgctggtggttgtcttggggtatctgtacagcggcaaggtgaaggcgtttccgaaaggggtgtgcgactgcgtggacgaggagtgccagcacgtggcttgtaggccagccttggagttcctggtgcaggtgctctatgcttcgtccaggtttcagattcctgagctggtggctctgtatcagaggcgcctactggacattctcgacaaggttgccccagatgacattttgcttgtgctatcggctgcaaatatatgtggagatgaatgtcatggattgctgacacaatgtttagaatatgtcatgaggtctgatctcgatactgttaccctagagaaaggcttgccttgcgctatcattgaacgaatcatcagtgcccgtttggaagttggtgtgaacattcctgaacgtataaacttccctgacaagcatgtgaagaggattcatcgggccctggacttggacgatgttgacttagtcagaatgctgctgaaggagggccataccactctggatgatgcacatgcacttcactatgctgtagcatactgtgatgcgaagaccttgactgagcttcttgatcttggaattgctgacgtaaattgtagaaatgcaagaggcttcacagttttgcatgttgctgcgatgaggaaagagccaaatgttattgtgtctctcctaatgaagggagctcagccttttgatctctctcctgatggtagaaaagctcttcaactatgtaagaggtgcacaaaagctgcagactacatggagtctaccgaggaaggaaagccttcaccgaacgacaaattatgtgtcgagatcttggagcaagctgaacaaagagagcccttacttggagaagcatccttttctcttgctgtggcaggtgatgatcggcgcatggaattgttgtatcttgaaaacagagttgcactagcaagactcctgtttcctatggaagcgaaagttgcgatggctattgctcaagtggacggcactcgtgaggtcccattgagtagcaggaattgtaaggacttggctggctcgctgaggatgcatatggacttggatgaggcaccttttcaagagcagcatctcaaaaggagtatagctctctcccgaactgtggaactcggcaaacgcttcttcccaagatgctcgaatgtacttagtaatattatggatgccgatgattgtactcggctagcatgccttgacaatggcactccagaagaacgacttttaaagaggagaaggttcacggaacttcaagaagcttttagcaaggctttcaacgaggataagaaggagttagacaaatcaaacgtttcttccttttcatcatcttcatcttctggagcaacgaggcctaagggaaagctccacatcaactatcgatcagtgaaactttgtgag

SEQ ID NO: 1014 - protein, 691 aa, Eucalyptus grandis
  Eucgr.C03423.1 polypeptide
MDGAKCDGLANKRDQKNEKASVKQERVAIRDDALSLSLSLSLLPRAAIRSGASRLCFFFRATDSSRAAVRACVRACSRFAWGGGMDYGAAALSDSNDASYSSGVCSTLTCVEAPSSSYSPDAAAAAAEAAAEAQALRRLSDSLESIFELPRAGSGFSFSDATIVAADGREVPVHRCVLAVRSPFFGAKFSGSQSGVRLEFKELAEDFGVGVGVGVGAEALVVVLGYLYSGKVKAFPKGVCDCVDEECQHVACRPALEFLVQVLYASSRFQIPELVALYQRRLLDILDKVAPDDILLVLSAANICGDECHGLLTQCLEYVMRSDLDTVTLEKGLPCAIIERIISARLEVGVNIPERINFPDKHVKRIHRALDLDDVDLVRMLLKEGHTTLDDAHALHYAVAYCDAKTLTELLDLGIADVNCRNARGFTVLHVAAMRKEPNVIVSLLMKGAQPFDLSPDGRKALQLCKRCTKAADYMESTEEGKPSPNDKLCVEILEQAEQREPLLGEASFSLAVAGDDRRMELLYLENRVALARLLFPMEAKVAMAIAQVDGTREVPLSSRNCKDLAGSLRMHMDLDEAPFQEQHLKRSIALSRTVELGKRFFPRCSNVLSNIMDADDCTRLACLDNGTPEERLLKRRRFTELQEAFSKAFNEDKKELDKSNVSSFSSSSSSGATRPKGKLHINYRSVKLCE

SEQ ID NO: 1015 - DNA, 1802 bp, Arabidopsis thaliana
  AtMYC1 (AT4G00480.1 or G581)
ctctttatcaatcactttggttccatacttttaaattcagttcttcacgatatctagatatgtctttgacaatggctgatggtgtagaagctgcagcaggaagaagtaaaagacaaaacagcttattaagaaaacaacttgctttagctgtaagaagtgttcaatggagctacgcaatcttctggtcgtcttcacttactcaacctggggttttggagtggggagaaggatgttacaatggagatatgaagaagaggaagaagagttatgaatctcattataaatatgggttgcaaaaaagcaaggagcttcggaaactttatttgtctatgcttgaaggagacagtggtactactgttagtactactcatgataatctcaatgatgatgatgataattgtcacagtacaagtatgatgctgtcaccagatgacctctctgatgaagagtggtactatttagtctccatgtcctatgtcttctctccttcacaatgtttgcctggaagagcttcagcgacgggtgagaccatatggctctgcaacgctcaatatgcggagaacaagctcttctctcgttctttgttagcaagaagcgcatcaattcagactgttgtgtgtttcccttacttgggcggagtcattgagctgggcgtcactgaattgatttcagaagaccataacctgcttcgaaacatcaaatcttgcttgatggaaatatctgcacaccaagacaacgatgacgagaagaagatggagattaagatcagtgaagagaagcatcagcttccattaggtatttctgatgaagacttgcattacaaaagaaccatttcaacagtactcaactactccgcagatagatcaggtaagaacgataagaacattcgtcatcgtcagccaaatattgttacttctgaacctggctcaagtttcttgcggtggaagcaatgtgagcagcaagtctcgggttttgttcagaaaaaaaagtcacagaatgtgttgcggaagatattgcatgatgtccctttgatgcacacaaagagaatgttcccaagtcagaactctggtctgaatcaagatgatccttcagatagaagaaaagagaacgaaaagttcagtgtccttagaactatggttcccactgtcaacgaggttgataaagaatcgatactaaacaacacaatcaagtacctgcaagaactggaggcaagagtagaagagctagaatcttgtatgggatcagttaattttgtagaaagacaaagaaagacgacagagaaccttaacgactctgtgttgatcgaagagacatcagggaactacgatgatagcacgaagatcgatgacaattcaggagaaaccgaacaagtcactgttttcagagataagacacatttgagagttaaactcaaagaaacagaagttgtgatcgaagtaagatgttcttacagagactacatagttgcggacatcatggaaactctgagcaatcttcacatggatgctttctctgttagatctcacacgctcaataagttcctcacattgaatctcaaggccaagtttcgcggggctgcagttgcgtccgtaggaatgattaagcgagagctgagaagagtcattggtgatttgttttaatgttcttcttagtaaaaattcttatattttcttaaacttttgatgaaatgttatatttatctagactttcgtgaaccgatatgcgatgtgccattatctttacatcaagttttcagggtttttgtatgtaaagtttgccaaagtttggttggaattttcgac

SEQ ID NO: 1016 - protein, 526 aa, Arabidopsis thaliana
  AtMYC1 (AT4G00480.1 or G581) polypeptide
MSLTMADGVEAAAGRSKRQNSLLRKQLALAVRSVQWSYAIFWSSSLTQPGVLEWGEGCYNGDMKKRKKSYESHYKYGLQKSKELRKLYLSMLEGDSGTTVSTTHDNLNDDDDNCHSTSMMLSPDDLSDEEWYYLVSMSYVFSPSQCLPGRASATGETIWLCNAQYAENKLFSRSLLARSASIQTVVCFPYLGGVIELGVTELISEDHNLLRNIKSCLMEISAHQDNDDEKKMEIKISEEKHQLPLGISDEDLHYKRTISTVLNYSADRSGKNDKNIRHRQPNIVTSEPGSSFLRWKQCEQQVSGFVQKKKSQNVLRKILHDVPLMHTKRMFPSQNSGLNQDDPSDRRKENEKFSVLRTMVPTVNEVDKESILNNTIKYLQELEARVEELESCMGSVNFVERQRKTTENLNDSVLIEETSGNYDDSTKIDDNSGETEQVTVFRDKTHLRVKLKETEVVIEVRCSYRDYIVADIMETLSNLHMDAFSVRSHTLNKFLTLNLKAKFRGAAVASVGMIKRELRRVIGDLF

SEQ ID NO: 1017 - DNA, 924 bp, Oryza sativa
  LOC_Os01g39560.1
atggcatctgctccttcagctcaggaagaacccctacagccagggacgatgcaattcaggaagcagcttgctgctgccgtgaggagcatcagttggacctatgccatcttttggtccatttcaactactcgtccaggagtcctgacatggaatgacgggttctacaacggcgagataaagacaaggaagatagagaacaacctagtgacggagctcacagctgagcagctcctcctacagagaagcgagcaactgagggagctgtacaactctctcctctctggtgagtctgcagaccaacagaggaggaggcctgtcactgcactatcgccggaggatctcggcaacgtagaatggtactacgttgtctgcatgacctacgccttccgccctggacaatgtgtgccaggtaaaagctttgcaagcaatggatgtgcctggctgtgcaacgctcagtctgccgatagcaaagccttcccgcgcaagctcttagccaagaacgcttctattcagacaattgtctgcgttccattcatgactggcgttcttgagcttgggaccactgatccggcggcggtggctagaggggaggcggcggcggcggggaggatgagccctatcctccgccagatctggcgagaaggaagggatagcgaggattcagtatacgaattgattaatcatgtgtttccctcgcttcatgataaaaataatgcaaactttgcatcttatatgagtacacatgccattctatccactaaaaatgattatgtggacaaactaaatgcaaatatgatcgacagattttcaaggcatgccaaggtttatcacagctttgactctgttgatgatgatcctcacaatagctatcatttggacttccttaactccatcacactccaaatggtctcccaccatacgagc

SEQ ID NO: 1018 - protein, 308 aa, Oryza sativa
  LOC_Os01g39560.1 polypeptide
MASAPSAQEEPLQPGTMQFRKQLAAAVRSISWTYAIFWSISTTRPGVLTWNDGFYNGEIKTRKIENNLVTELTAEQLLLQRSEQLRELYNSLLSGESADQQRRRPVTALSPEDLGNVEWYYVVCMTYAFRPGQCVPGKSFASNGCAWLCNAQSADSKAFPRKLLAKNASIQTIVCVPFMTGVLELGTTDPAAVARGEAAAAGRMSPILRQIWREGRDSEDSVYELINHVFPSLHDKNNANFASYMSTHAILSTKNDYVDKLNANMIDRFSRHAKVYHSFDSVDDDPHNSYHLDFLNSITLQMVSHHTS

SEQ ID NO: 1019 - DNA, 1677 bp, Oryza sativa
  LOC_Os04g47040.1
atggcatctgctcctccagttcaggaagaacccctacagccagggacgaaccacttcaggagcctgcttgctgctgctgtgaggagcatcagttggagttatgcgatcttttggtccatttcaaccagttgcccaggagttttgacttggaatgatgggttctacaacggcgtggtaaagacgaggaagatatccaactcagcagacctcacggctggtcagctcgtcgtgcagagaagcgagcaactgagggagctttactactctctcctgtccggcgagtgcgaccaccgggcgaggaggcccattgccgcgctatcgccggaagatctcgcagacacagaatggtactacgtcgtctgcatgacctactccttccaacccggccaagggctgccaggcaaaagctatgcaagcaatgcatctgtttggctgcgcaatgctcagtctgcagatagcaaaacatttctacgctcgctattagctaagagcgcgtctattcagacaatcatctgcatccccttcacgagtggcgtgcttgagctggggaccactgatccggttttggaggacccaaagttggtaaaccgaatcgttgcatatttccaggagcttcagtttccgatatgcttagaggtactaatgagcactagcccttctccgaacgaaacggaagatgccgacatcgtgtccgaaggcctcatcactcacaacgccatcgaagaggggcagatggttgtctctgatgagtgcgtgtccaacgccaaccgcgatccaatcaccatggagatcgacgagctctacagcatctacgaggacctggacctggacatggacctggacctggacaccgtgcgctttctcgaggataatggctggcctgtgaaccccagctcttttcaactggtcccggcgtcgtcaacggaggcggtggcggcggcggcggcggctaatgatgtcgacggtgttgcgaattctcaagtgtcgtgcttcatggcttggaagagcgcgaagtcaaacgagatggctgtgccggtcgtcaccggtatagagtcacagaagttgctgaagaaagttgtggactgtggtgcacggatgagcactggtcgtggtagtagagcagcgctaactcaagagagtggcatcaagaaccatgtcatatcagagagaaggcgccgagagaagctcaatgagatgttcctgattctgaagtcaatagtcccctccatccacaaggtggacaaagcatccatccttgaagaaacgattgcctacctcaaagtgttggagaaaagggtgaaagagttggagtccagcagcgagccatcacatcagcgcgcaaccgaaacaggacagcaaaggcgctgtgagatcaccgggaaggagctggtctctgagatcggtgtcagcggcggcggcgatgcagggagagaacaccaccacgtgaatgtcaccgtcacggacaaggtggttctcctggaggtgcagtgccgatggaaggagttggtgatgacacgagtgttcgacgcgatcaagagcctctgtcttgacgttctctccgtgcaggcgtcggcaccggatggtcttcttggactgaagatacaagctaagtttgcttgttctggttcagtggcacctgggatgatcagcgaagctctccagaaagctatcggtggc

SEQ ID NO: 1020 - protein, 559 aa, Oryza sativa
  LOC_Os04g47040.1 polypeptide
MASAPPVQEEPLQPGTNHFRSLLAAAVRSISWSYAIFWSISTSCPGVLTWNDGFYNGVVKTRKISNSADLTAGQLVVQRSEQLRELYYSLLSGECDHRARRPIAALSPEDLADTEWYYVVCMTYSFQPGQGLPGKSYASNASVWLRNAQSADSKTFLRSLLAKSASIQTIICIPFTSGVLELGTTDPVLEDPKLVNRIVAYFQELQFPICLEVLMSTSPSPNETEDADIVSEGLITHNAIEEGQMVVSDECVSNANRDPITMEIDELYSIYEDLDLDMDLDLDTVRFLEDNGWPVNPSSFQLVPASSTEAVAAAAAANDVDGVANSQVSCFMAWKSAKSNEMAVPVVTGIESQKLLKKVVDCGARMSTGRGSRAALTQESGIKNHVISERRRREKLNEMFLILKSIVPSIHKVDKASILEETIAYLKVLEKRVKELESSSEPSHQRATETGQQRRCEITGKELVSEIGVSGGGDAGREHHHVNVTVTDKVVLLEVQCRWKELVMTRVFDAIKSLCLDVLSVQASAPDGLLGLKIQAKFACSGSVAPGMISEALQKAIGG

SEQ ID NO: 1021 - DNA, 1722 bp, Oryza sativa
  LOC_Os04g47080.1
atggaagagacccctctgccatccgggaagaacttcaggagccagcttgctgctgcagcgaggagcatcaattggacgtatgccatattttggtccatttcaaccagccgcccaggagttctgacttggaaggacggcttctacaacggcgagataaagacgaggaagatcacgaactccatgaacctcatggccgacgagctggtcctgcagagaagcgagcagctgagggagctctacgactctctcctctccggcgagtgcggccaccgagcgaggaggcccgtcgctgcactgttgccggaagatctcggggacacggaatggtactacgtcgtctgcatgacctacgccttcggcccccgccaagggttgccaggcaaaagcttcgcaagcaatgaatttgtttggctgacaaacgctcagtctgcagatagaaaactattccatcgcgcgcttatagcaaagagtgcatctattaagacaatcgtctgcgtgccatttatcatgcatggtgtccttgagctcgggaccactgatccgatttcggaggacccggctctcgtcgaccgtatcgcggcgtcgttctgggatacgccgccccgcgcggcgttctcgtcggaggcgggagacgccgacatcgtcgtcttcgaagacctcgaccatggcaacgccgccgtcgaagcgacgacgacgacggtcccgggggagccacacgcggtagccggcggcgaggtcgccgagtgcgagcccaactccgacaacgacctcgagcagatcaccatggacgacatcggcgagctctacagcctctgcgaggagctggacgtcgtgcgccctctcgacgacgacagtagcagctgggcggtcgcggatccctggtcgtcctttcagctagttccgacgtcttctccggcgccggatcaggcgccggcggcggaagctactgacgtcgacgacgtcgtcgtcgccgctttagacagtagctccattgatggatcttgcaggccgtcgccgtcgagttttgtggcgtggaagaggacggcggactcggacgaggtgcaggccgtgccgctcatcagcggagagccgccacagaagttgctgaagaaagctgtcgccggagccggtgcctggatgaacaatggtgacagcagcgcggcggcgatgacgactcaaggaagcagcatcaagaaccatgtcatgtcagagagaaggcgccgggagaagctcaacgagatgttcctgattctcaaatcagttgtcccgtccattcacagggtggacaaagcatccattctcgcagaaacgatagcctacctcaaagagctggagaaaagagtggaagagctggaatccagcagccaaccatcgccatgtccattggaaacaagaagcaggcgaaagtgccgtgagatcactgggaagaaggtttctgcaggagcgaagagaaaggcgccggcgccggaggtggccagcgacgacgacaccgacggggagcggcgccattgtgtgagcaacgtgaacgtcaccatcatggacaacaaggaggttctcctcgagctgcaatgccagtggaaggaattgctgatgacgagagtgttcgacgcgatcaagggagtctccctggatgtcctctcggtgcaggcatcaacatcggatggtctccttggactgaagatacaagccaagtttgcctcatctgctgccgtcgaacctgga

SEQ ID NO: 1022 - protein, 574 aa, Oryza sativa
  LOC_Os04g47080.1 polypeptide
MEETPLPSGKNFRSQLAAAARSINWTYAIFWSISTSRPGVLTWKDGFYNGEIKTRKITNSMNLMADELVLQRSEQLRELYDSLLSGECGHRARRPVAALLPEDLGDTEWYYVVCMTYAFGPRQGLPGKSFASNEFVWLTNAQSADRKLFHRALIAKSASIKTIVCVPFIMHGVLELGTTDPISEDPALVDRIAASFWDTPPRAAFSSEAGDADIVVFEDLDHGNAAVEATTTTVPGEPHAVAGGEVAECEPNSDNDLEQITMDDIGELYSLCEELDVVRPLDDDSSSWAVADPWSSFQLVPTSSPAPDQAPAAEATDVDDVVVAALDSSSIDGSCRPSPSSFVAWKRTADSDEVQAVPLISGEPPQKLLKKAVAGAGAWMNNGDSSAAAMTTQGSSIKNHVMSERRRREKLNEMFLILKSVVPSIHRVDKASILAETIAYLKELEKRVEELESSSQPSPCPLETRSRRKCREITGKKVSAGAKRKAPAPEVASDDDTDGERRHCVSNVNVTIMDNKEVLLELQCQWKELLMTRVFDAIKGVSLDVLSVQASTSDGLLGLKIQAKFASSAAVEPG

SEQ ID NO: 1023 - DNA, 1671 bp, Zea mays
  GRMZM2G172795_T01
atggcgctctcagcttgcccggctcaggaagaactgctgcagcctgctgggaggccgttgaggaagcagcttgctgcagccgcgaggagcatcaactggagctattccctcttctggtccatttcaagcactcaacgaccacgggtgctgacgtggacggacgggttctacaatggcgaggtgaagacgcgtaagatctcccactccgtggagctgacagccgaccagctgctcatgcagaggagcgagcagctccgggagctctacgaggccctccagtccggcgagtgcgaccgccgcgcggcgcggccggtgggctcgctgtcgccggaggacctcggggacaccgagtggtactacgtgatctgcatgacctacgccttcctgcctggccaaggcttgcccggcaggagttccgcgagcaacgagcatgtctggctgtgcaacgcgcacctcgccggcagcaaggacttcccccgcgcgctcctggccaaggtgccggaggacccggacttgatcaaccgagcaaccgcagcctttcgggagccgcaatgtccgatatactcggaacagccgagctccaacccgtcagcagacgaaaccggcgaggccgcagacatagctgtgttcgagggcctcgatcacaatgccatggacatggagaccgcaggcatagctgtgttcgagggcctcgatcacaatgccatggacatggagacggtgactgccgccgccgggagacacggaaccggacaggagctaggagaagccgacagcccgtcaaatgcaagcctggagcacatcaccaaggggatcgacgagttctacaacctctgcgaggaaatggacgtgcagccgctagaggatgcctggataatggacgggtctaatttcgaagtcccctcgtcagcgctcccggtggatggctcaagcgcacccgctgatggctctcgcgcgaccagtttcgtggcttggacgaggtcatcgcagtcctgctccggtgaagcggcggctgtgccggtcatcgaagagccgcagaaattgctgaagaaagcggtggccggcggcggtgcttgggcgaacacgaactgcggtggcgggggcacgacggtaacagcccaggaaaacggcgccaagaaccacgtcatgttagagcgaaagcgccgggagaagctcaacgagatgttcctcgttctcaagtcgttggttccctccattcacaaggtggacaaagcatccatcctcgccgaaactatagcctacctaaaggagcttcaacgaagggtacaagaactggaatccaggaggcaaggtggcagtgggtgtgtcagcaagaaagtctgtgtgggctccaactccaagaggaagagcccagagttcgccggtggcgcgaaggagcacccctgggtcctccccatggacggtaccagcaacgtcaccgtcaccgtctctgacagggacgtgctcctggaggtgcaatgcctgtgggagaagctcctgatgacacgggtgttcgacgccatcaagagcctccatttggacgctctctcggttcaggcttcggcactagatggcttcatgaggctcaagataggagctcagtttgcaggctccggcgccgtcgtgcccggaatgatcagccaatctcttcgtaaagctatagggaagcga

SEQ ID NO: 1024 - protein, 557 aa, Zea mays
  GRMZM2G172795_T01  polypeptide
MALSACPAQEELLQPAGRPLRKQLAAAARSINWSYSLFWSISSTQRPRVLTWTDGFYNGEVKTRKISHSVELTADQLLMQRSEQLRELYEALQSGECDRRAARPVGSLSPEDLGDTEWYYVICMTYAFLPGQGLPGRSSASNEHVWLCNAHLAGSKDFPRALLAKVPEDPDLINRATAAFREPQCPIYSEQPSSNPSADETGEAADIAVFEGLDHNAMDMETAGIAVFEGLDHNAMDMETVTAAAGRHGTGQELGEADSPSNASLEHITKGIDEFYNLCEEMDVQPLEDAWIMDGSNFEVPSSALPVDGSSAPADGSRATSFVAWTRSSQSCSGEAAAVPVIEEPQKLLKKAVAGGGAWANTNCGGGGTTVTAQENGAKNHVMLERKRREKLNEMFLVLKSLVPSIHKVDKASILAETIAYLKELQRRVQELESRRQGGSGCVSKKVCVGSNSKRKSPEFAGGAKEHPWVLPMDGTSNVTVTVSDRDVLLEVQCLWEKLLMTRVFDAIKSLHLDALSVQASALDGFMRLKIGAQFAGSGAVVPGMISQSLRKAIGKR

SEQ ID NO: 1025 - DNA, 1755 bp, Zea mays
  GRMZM5G822829_T01
atggaatccctgggtggctcacaaattagcggggaggttggccttctgcagcagcgcttggagaagaagttgtcaagggtgctgacgtggacggacgggttctacaacggcgaggtgaagacgcggaagatctccaactccgtggagctgacatccgaccacctcgtcatgcagaggagcgaccagctccgggagctctacgaggccctgctgtcgggcgagggcgaccgccgcgctgcgcctgcgcggccggccggctcgctgtcgccggaggacctcggggacaccgagtggtattacgtggtctccatgacctacgccttccggccaggccaagggttgcccggcaggagtttcgcgagcgacgagcatgtctggctgtgcaacgcgcacctcgccggcagcaaagccttcccccgcgcgctcctggccaagtcaatcctctgcatcccggttatgggcggcgtgcttgagcttggtacaactgacacggtgccggaggccccggacttggtcagccgagcaaccgcggctttctgggagccgcagtgcccgacgtactcggaagagccgagctccagcccgtcaggacgagcaaacgagaccggcgaggccgcagcagacgacggcacgtttgcgttcgaggaactcgaccacaataatggcatggacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggacagggctaccgctaacgtcgccgccgacgcctcaagggcacccgtctacggctctcgcgcgacgagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcatcatggacgccggcaccagcaacgtcaccgtcaccgtctcggacaaggacgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaagcgg

SEQ ID NO: 1026 - protein, 585 aa, Zea mays
  GRMZM5G822829_T01  polypeptide
MESLGGSQISGEVGLLQQRLEKKLSRVLTWTDGFYNGEVKTRKISNSVELTSDHLVMQRSDQLRELYEALLSGEGDRRAAPARPAGSLSPEDLGDTEWYYVVSMTYAFRPGQGLPGRSFASDEHVWLCNAHLAGSKAFPRALLAKSILCIPVMGGVLELGTTDTVPEAPDLVSRATAAFWEPQCPTYSEEPSSSPSGRANETGEAAADDGTFAFEELDHNNGMDIEAMTAAGGHGQEEELRLREAEALSDDASLEHITKEIEEFYSLCDEMDLQALPLPLEDGWTVDASNFEVPCSSPQPAPPPVDRATANVAADASRAPVYGSRATSFMAWTRSSQQSSCSDDAAPAAVVPAIEEPQRLLKKVVAGGGAWESCGGATGAAQEMSGTGTKNHVMSERKRREKLNEMFLVLKSLLPSIHRVNKASILAETIAYLKELQRRVQELESSREPASRPSETTTRLITRPSRGNNESVRKEVCAGSKRKSPELGRDDVERPPVLIMDAGTSNVTVTVSDKDVLLEVQCRWEELLMTRVFDAIKSLHLDVLSVQASAPDGFMGLKIRAQFAGSGAVVPWMISEALRKAIGKR

SEQ ID NO: 1027 - DNA, 1830 bp, Zea mays
  GRMZM5G822829_T03
atggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatctccaactccgtggagctgacatccgaccacctcgtcatgcagaggagcgaccagctccgggagctctacgaggccctgctgtcgggcgagggcgaccgccgcgctgcgcctgcgcggccggccggctcgctgtcgccggaggacctcggggacaccgagtggtattacgtggtctccatgacctacgccttccggccaggccaagggttgcccggcaggagtttcgcgagcgacgagcatgtctggctgtgcaacgcgcacctcgccggcagcaaagccttcccccgcgcgctcctggccaagtcaatcctctgcatcccggttatgggcggcgtgcttgagcttggtacaactgacacggtgccggaggccccggacttggtcagccgagcaaccgcggctttctgggagccgcagtgcccgacgtactcggaagagccgagctccagcccgtcaggacgagcaaacgagaccggcgaggccgcagcagacgacggcacgtttgcgttcgaggaactcgaccacaataatggcatggacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggacagggctaccgctaacgtcgccgccgacgcctcaagggcacccgtctacggctctcgcgcgacgagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcatcatggacgccggcaccagcaacgtcaccgtcaccgtctcggacaaggacgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaagcgg

SEQ ID NO: 1028 - protein, 610 aa, Zea mays
  GRMZM5G822829_T03  polypeptide
MALSASRVQQAEELLQRPAERQLMRSQLAAAARSINWSYALFWSISDTQPGVLTWTDGFYNGEVKTRKISNSVELTSDHLVMQRSDQLRELYEALLSGEGDRRAAPARPAGSLSPEDLGDTEWYYVVSMTYAFRPGQGLPGRSFASDEHVWLCNAHLAGSKAFPRALLAKSILCIPVMGGVLELGTTDTVPEAPDLVSRATAAFWEPQCPTYSEEPSSSPSGRANETGEAAADDGTFAFEELDHNNGMDIEAMTAAGGHGQEEELRLREAEALSDDASLEHITKEIEEFYSLCDEMDLQALPLPLEDGWTVDASNFEVPCSSPQPAPPPVDRATANVAADASRAPVYGSRATSFMAWTRSSQQSSCSDDAAPAAVVPAIEEPQRLLKKVVAGGGAWESCGGATGAAQEMSGTGTKNHVMSERKRREKLNEMFLVLKSLLPSIHRVNKASILAETIAYLKELQRRVQELESSREPASRPSETTTRLITRPSRGNNESVRKEVCAGSKRKSPELGRDDVERPPVLIMDAGTSNVTVTVSDKDVLLEVQCRWEELLMTRVFDAIKSLHLDVLSVQASAPDGFMGLKIRAQFAGSGAVVPWMISEALRKAIGKR

SEQ ID NO: 1029 - DNA, 1701 bp, Setaria italica
  Si000845m
atggcactaccagcttccccagttcaggaagaactgcagccggagagtcaattgaggaaccatcttgctgcagccgtgaggagcatcaactggacttatgccctcttctggtccatttcaagcactcagccaggattcctaacgtggacggatgggttctacaacggcgaggtgaagacgaggaagatcgtcaactctgcggagctgaccgccgaccagctcgtcatgcagcgaagcgagcagctgcgggagctctacgaggccctcctctccggcgagtgcgaccgccgggcggcgcggccggtcgcctcgctgtcgccggaggacctcggcgacaccgaattgtactacgtggtctgcatgacctacgccttccggccaggccaagggttgccgggaaggagctttgctagcaacgaacgtgtctggatgtggaactctcacctcgccgacagcaaagccttcccccgcgcgctcctggcgaagacaatcgtctgcatcccgctcatgagcggcgtgcttgagctggggacaactgatgcggtggtggaggatccaagcttggtcagccgagccactgcatctttctgcgagatgcagtttccggcatgctcgcaggagccgagctccagcccgtcagcaaacgaaaccggcaagcccgccgacattatcgtgttcgaggacctcgatcacattgccatggaagcgatgatcgccggcggacaggagctaggcgaagcggagagcctgtcagatggaagcctcgagcaaatcaccaaggagatcgacgaattctacagcctctgcgaggaaatggacgtgcagccactcgaggatacctggatcatggacgggtctttcgaagtcccctcttcgcagcagccggcgccggggcctgctactactaacgccgccgccacctcaagcgctctcgttgacggctctcgcgcgacgagctttacggcctgggcgaggccggagtcggactccaatgaagtggctgtgccggtcgtcgaagagccacagaagctgctgaagaaagcggtggccggcggagcttgggcggcgaacaatggcggcggcggcacgacgagaatggcccaagaaagtggcgtcaagaaccacgtcatgtcggagaggaagcgccgggagaagctcaacgagatgttcctcgttctcaagtcattggttccctccattcacaaggtggacaaagcatcgatccttgccgaaacgatagcgtacctcaaggagcttcaacgaagggtacaagagctagaatccagcagggaacccataatctcgcgcccatccgaaacaacgagggcaacaaggcgccatgacgatgaggccgtcaggaagaaagtctgtgccgcgggctccaagaggaagggctcggagctcggcggtgacgtggagagggagcaccacccacgggccctctccaaggacagcaccagcaacgtcaccgtcaccgtctcggacaaggaggtgctcgtggaggtgcagtgccggtgggaagagcttctgatgacgcgagtgttcgacgccatcaagagcctgcaactggacgttctctcggttcaggcatcggcaccggatgggttcatggggctgaagatacgggctcagtttgccggctcagctgccgttgtgccgtggatgatcagcgaggccctccgtaaagctatagggaagcga

SEQ ID NO: 1030 - protein, 567 aa, Setaria italica
  Si000845m  polypeptide
MALPASPVQEELQPESQLRNHLAAAVRSINWTYALFWSISSTQPGFLTWTDGFYNGEVKTRKIVNSAELTADQLVMQRSEQLRELYEALLSGECDRRAARPVASLSPEDLGDTELYYVVCMTYAFRPGQGLPGRSFASNERVWMWNSHLADSKAFPRALLAKTIVCIPLMSGVLELGTTDAVVEDPSLVSRATASFCEMQFPACSQEPSSSPSANETGKPADIIVFEDLDHIAMEAMIAGGQELGEAESLSDGSLEQITKEIDEFYSLCEEMDVQPLEDTWIMDGSFEVPSSQQPAPGPATTNAAATSSALVDGSRATSFTAWARPESDSNEVAVPVVEEPQKLLKKAVAGGAWAANNGGGGTTRMAQESGVKNHVMSERKRREKLNEMFLVLKSLVPSIHKVDKASILAETIAYLKELQRRVQELESSREPIISRPSETTRATRRHDDEAVRKKVCAAGSKRKGSELGGDVEREHHPRALSKDSTSNVTVTVSDKEVLVEVQCRWEELLMTRVFDAIKSLQLDVLSVQASAPDGFMGLKIRAQFAGSAAVVPWMISEALRKAIGKR

SEQ ID NO: 1031 - DNA, 1488 bp, Setaria italica
  Si012401m
ttcctaacgtggacggatgggttctacaacggcgaggtgaagacgaggaagatcgccaactctgcggagctgaccgccgaccagctcgtcatgcagcgaagcgagcagctgcgggagctctacgaggccctcctctccggcgagtgcgaccgccggacggcgcggccggtcgcctcgctgtcgccggaggacctcggcgacaccgagtggtactacgtggtctgcatgacctacgccttccggccaggccaagggttgccgggaaggagctttgctagcaacgaacgtgtctggatgcggaactctcacctcgccgacagcaaagccttcccccgcgcgctcctggcgaagacaatcgtctgcatcccgttcatgagcggcgtgcttgagctggggacaactgatgcggagccgagctccagcccgtcagcaaacgaaaccggcaagcccgccgacattatcgtgttcgaggacctcgatcacattgccatggaagcgatgatcgccggcggacaggagctaggcgaagcggagagcctgtcagatggaaccctcgagcaaatcaccaaggagatcgacgaattctacagcctctgcgaggaaatggacgtgcagccactcgaggatacctggatcatggacgggtctttcgaagtcccctcttcgccgcagccggcgccggggcctgctactactaacgccgccgccacctcaagcgctctcgttgacggctctcgcgcgacgagctttacggcctgggcgaggccggagtcggactccgatgaagtggctgtgccggtcgtcgaagagccacagaagctgctgaagaaagcggtggccggcggagcttgggcggcgaacaatggcggcggcggcacgacgagaatggcccaagaaagtggcgtcaagaaccacgtcatgtcggagaggaagcgccgggaaaagctcaacgagatgttcctcgttctcaagtcattggttccctccattcacaaggtggacaaagcatcgatccttgccgaaacgatagcgtacctcaaggagcttcaacgaagggtacaagagctagaatccagcagggaacccataatctcgcgcccatccgaaacaacgagggcaacaaggcgccatgacgatgaggccgtcaggaagaaagtctgtgccgcgggctccaagaggaagggctcggagctcggcggtgacgtggagagggagcacccacgggccctctccaaggacggcaccagcaacgtcaccgtcaccgtctcagacaaggaggtgctcgtggaggtgcagtgccggtgggaagagcttctgatgacgcgagtgttcgacgcaatcaagagcctgcaactggacgttcactcggttcaggcatcggcaccggatgggttcatggggctgaagatacgggctcagtttgccggctcagctgccgttgtgccgtggatgatcagcgaggccctccgtaatgctatagggaagcga

SEQ ID NO: 1032 - protein, 496 aa, Setaria italica
  Si012401m  polypeptide
FLTWTDGFYNGEVKTRKIANSAELTADQLVMQRSEQLRELYEALLSGECDRRTARPVASLSPEDLGDTEWYYVVCMTYAFRPGQGLPGRSFASNERVWMRNSHLADSKAFPRALLAKTIVCIPFMSGVLELGTTDAEPSSSPSANETGKPADIIVFEDLDHIAMEAMIAGGQELGEAESLSDGTLEQITKEIDEFYSLCEEMDVQPLEDTWIMDGSFEVPSSPQPAPGPATTNAAATSSALVDGSRATSFTAWARPESDSDEVAVPVVEEPQKLLKKAVAGGAWAANNGGGGTTRMAQESGVKNHVMSERKRREKLNEMFLVLKSLVPSIHKVDKASILAETIAYLKELQRRVQELESSREPIISRPSETTRATRRHDDEAVRKKVCAAGSKRKGSELGGDVEREHPRALSKDGTSNVTVTVSDKEVLVEVQCRWEELLMTRVFDAIKSLQLDVHSVQASAPDGFMGLKIRAQFAGSAAVVPWMISEALRNAIGKR

SEQ ID NO: 1033 - DNA, 1788 bp, Arabidopsis thaliana
  AT1G63650.1
atggcaaccggagaaaacagaacggtgccggacaatctaaagaaacagctcgcagtttcagttcgaaacattcaatggagttatggaatcttctggtctgtctctgcttctcaaccaggagtgttggagtggggagatggatattacaatggagacataaagacaaggaagacgattcaagcagcagaagtcaaaattgaccagttaggtcttgagagaagtgagcagcttagagagctttatgaatctctctccctcgctgaatcctcagcttccggtagctctcaggtcactagacgagcttccgccgccgctctctcaccggaggacctcaccgacaccgagtggtactacttagtatgcatgtctttcgtcttcaacatcggtgaaggaatccccggaggagcgttatccaatggagaaccaatatggctttgtaacgctgaaaccgccgatagcaaagtcttcactcgttctcttctagctaaaagtgcttcgcttcagacagtggtttgcttcccgtttcttggaggagtccttgagattggcacgaccgaacatattaaagaggacatgaacgtgatacaaagtgttaagacgttgttccttgaagctcctccatatactacaatatcgacaagatcagactatcaagaaatttttgatcccttaagtgacgataaatacactccggtgtttataaccgaagcttttccaacaacttctactagcgggtttgagcaagaacctgaggatcatgattcgttcatcaacgatggtggtgcgtctcaggtacaaagctggcagtttgtgggtgaagaaatcagtaactgcattcaccaatcgttaaattcaagcgattgcgtttcccaaacgtttgttggaacaaccgggagacttgcttgcgatccaaggaagagtaggattcaacggttaggtcagattcaagaacagagtaaccatgtaaatatggacgacgatgttcattaccaaggcgtgatatcgacgattttcaaaacaacgcatcagctaatactcggaccgcagtttcagaacttcgataagcggtctagcttcacaaggtggaagcgatcatcatctgtgaaaacattgggagagaaatcgcagaagatgataaagaagatactcttcgaggttcctttgatgaacaagaaagaagagttgttaccggacacaccagaggaaaccgggaaccatgccttgtccgagaagaaacgccgcgagaaattgaatgaacggtttatgacattgagatcaatcattccctcaattagtaagattgataaagtgtcgattcttgatgatacaattgagtatcttcaagatttacagaaacgggttcaagagttggaatcttgtagagaatctgctgatacagagacacggataacgatgatgaagaggaagaaaccggatgatgaggaggaaagagcatcagcgaattgtatgaacagcaaaaggaaggggagtgatgtgaatgtaggagaagatgaaccagctgatatcggttatgctggtctaacggataacttaaggatcagttcattaggtaacgaggtggttattgagcttagatgcgcttggagagaagggatattgcttgagataatggatgtgattagtgatctcaacttggattctcactcggttcagtcgtcaaccggagacggtttactctgcttaactgtcaattgcaagcataaagggacaaaaatagcaacaacaggaatgatccaagaggcacttcaaagggttgcatggatatgt

SEQ ID NO: 1034 - protein, 596 aa, Arabidopsis thaliana
  AT1G63650.1  polypeptide
MATGENRTVPDNLKKQLAVSVRNIQWSYGIFWSVSASQPGVLEWGDGYYNGDIKTRKTIQAAEVKIDQLGLERSEQLRELYESLSLAESSASGSSQVTRRASAAALSPEDLTDTEWYYLVCMSFVFNIGEGIPGGALSNGEPIWLCNAETADSKVFTRSLLAKSASLQTVVCFPFLGGVLEIGTTEHIKEDMNVIQSVKTLFLEAPPYTTISTRSDYQEIFDPLSDDKYTPVFITEAFPTTSTSGFEQEPEDHDSFINDGGASQVQSWQFVGEEISNCIHQSLNSSDCVSQTFVGTTGRLACDPRKSRIQRLGQIQEQSNHVNMDDDVHYQGVISTIFKTTHQLILGPQFQNFDKRSSFTRWKRSSSVKTLGEKSQKMIKKILFEVPLMNKKEELLPDTPEETGNHALSEKKRREKLNERFMTLRSIIPSISKIDKVSILDDTIEYLQDLQKRVQELESCRESADTETRITMMKRKKPDDEEERASANCMNSKRKGSDVNVGEDEPADIGYAGLTDNLRISSLGNEVVIELRCAWREGILLEIMDVISDLNLDSHSVQSSTGDGLLCLTVNCKHKGTKIATTGMIQEALQRVAWIC

SEQ ID NO: 1035 - DNA, 1911 bp, Arabidopsis thaliana
  AT5G41315.1
atggctaccggacaaaacagaacaactgtgccagagaatctgaagaaacacctcgcagtttcagttcgaaacattcaatggagttatggtatcttttggtctgtctctgcttctcagtctggagttttagaatggggagatggatactataatggagatatcaaaacgaggaagacgattcaagcttcggagatcaaagctgatcagcttggtctacggaggagcgagcagcttagcgagctttacgagtctctctccgtcgctgaatcttcttcttcaggcgttgctgccggatctcaagtcaccagacgagcttccgccgccgcactttcaccggaagatctcgccgacaccgagtggtactatttggtttgtatgtctttcgtcttcaacattggtgaaggaatgcctggacggacgtttgcaaacggtgaaccgatatggttgtgcaacgctcatacggcggatagtaaagtgtttagccgttctcttctagcaaaaagtgctgcggttaagacagtggtttgcttcccgttccttggaggagtcgttgagattggtaccacagaacatattacggaagacatgaatgtaatacaatgcgtgaagacatcattcctcgaagcccctgatccgtacgctacaatattaccagcaagatccgattatcacatcgacaacgttcttgatccgcaacagattctaggcgacgagatttacgcgcctatgttcagtacggagccttttccaacagcttctccgagcagaactaccaacggtttcgatcaagaacatgaacaagtagcagatgatcatgattctttcatgaccgaaagaatcactggaggagcttctcaggtgcaaagctggcagctcatggacgacgagcttagtaactgcgttcaccagtcgctaaattccagcgattgcgtctctcaaacgtttgttgaaggggcggctggacgggttgcttacggtgcaagaaagagtagagttcaaagactagggcaaattcaagagcaacagagaaatgtgaagacattgtcatttgatccaagaaacgacgacgttcattaccaaagtgtgatctcaacgatttttaagaccaaccatcagttaattctcggaccgcagtttcgaaactgcgataaacagtcaagcttcactaggtggaagaaatcatcgtcatcatcatcaggaaccgccacggtcacggcaccatcacaaggaatgttaaagaaaattattttcgatgttccgcgagtgcaccagaaagagaagttaatgttggactcaccagaagccagagatgaaactgggaaccatgcggttttagagaagaagcgccgcgagaaattgaacgaacggttcatgaccttgagaaaaatcattccgtcaatcaacaagatcgataaagtatcgattcttgacgatacgatagagtatcttcaagaactcgagagacgggttcaagaactagaatcttgcagagaatcaaccgatacagagactcgtgggacgatgacgatgaagaggaagaaaccatgcgacgcaggagaaagaacatcagctaattgcgcaaataatgaaacaggaaatgggaagaaggtgtcggttaacaatgttggtgaagccgagccagcagataccggttttactggtttaaccgataatttaaggatcggttcgtttggtaatgaggtggttattgagcttagatgtgcttggagagaaggagtattgcttgagataatggatgtgattagtgatctccatttggattctcattcggttcaatcctcgaccggagacggtttgctctgcttaaccgtcaattgcaagcacaaggggtcaaaaatagcgacaccaggaatgatcaaagaagcacttcaaagggttgcatggatctgt

SEQ ID NO: 1036 - protein, 637 aa, Arabidopsis thaliana
  AT5G41315.1  polypeptide
MATGQNRTTVPENLKKHLAVSVRNIQWSYGIFWSVSASQSGVLEWGDGYYNGDIKTRKTIQASEIKADQLGLRRSEQLSELYESLSVAESSSSGVAAGSQVTRRASAAALSPEDLADTEWYYLVCMSFVFNIGEGMPGRTFANGEPIWLCNAHTADSKVFSRSLLAKSAAVKTVVCFPFLGGVVEIGTTEHITEDMNVIQCVKTSFLEAPDPYATILPARSDYHIDNVLDPQQILGDEIYAPMFSTEPFPTASPSRTTNGFDQEHEQVADDHDSFMTERITGGASQVQSWQLMDDELSNCVHQSLNSSDCVSQTFVEGAAGRVAYGARKSRVQRLGQIQEQQRNVKTLSFDPRNDDVHYQSVISTIFKTNHQLILGPQFRNCDKQSSFTRWKKSSSSSSGTATVTAPSQGMLKKIIFDVPRVHQKEKLMLDSPEARDETGNHAVLEKKRREKLNERFMTLRKIIPSINKIDKVSILDDTIEYLQELERRVQELESCRESTDTETRGTMTMKRKKPCDAGERTSANCANNETGNGKKVSVNNVGEAEPADTGFTGLTDNLRIGSFGNEVVIELRCAWREGVLLEIMDVISDLHLDSHSVQSSTGDGLLCLTVNCKHKGSKIATPGMIKEALQRVAWIC

SEQ ID NO: 1037 - DNA, 1968 bp, Citrus clementina
  clementine0.9_004500m
atggctagtgctgctcaaaaccaggagggggtgccagaaatcttaagaaaacagcttgctgttgctgttaggagtatccaatggagctatgcaattttctggtcattatcagctgcacaacaaggggttctagagtggggtgatgggtactataatggagacatcaagactaggaagacaatgcaagcaatggaacttacacctgataaaataggtttacaaaggagtaagcaactaagagagctttacgagtctttgctgaaaggagaatctgagctggcttataagaggccttctgctgcattgtctccagaagatcttactgatgcagagtggtattacttggtttgcatgtcctttgtattcagttctggccaaggtttgccaggaagagcacttgcaaacagtgaaacaatctggttatgcaatgctcagtgtgcagatagtaaagtattctctcgctctttattggccaagagtgcatctattcagactgtcatatgctttcctcatcttgatggtgtaattgaacttggagtcactgaactggtcccagaggatcctagtctccttcaacatatcaaagcctcattattagacttctcaaagcctttttgctctgagaaatcttcctctcctccttacgatgaagatgatgacagtgaccctctgtgtgccaaggttagccatgagatattggatacagtggctttggagagcctatattctcccggagaagaaaacaaatttgatggggagggagtttatgaactacatggaaacatcaatgaagaattgcacttagattctgctgatgaatgctcaaagggctgtgagcacaatcaccagacagaagaatccttcatggttgatggtataaatggtgcagcttctcaagttcagagttggcattttgtagatgatgacctcagcaatggtattccagactccatgcattctagtgaccataaatctgaatctctcgtgaatcaagcagagggttttccttcttccaaggatgaaaacatgagccacattcaattgaaagaacttcaagaaggcaatcatacaaaactaagtttgttggatcttgggatagttgatggtgcacactacaggaaaactctttctgctatttttggaagttcaaatcggttgactgagaacccgtgtttccttagtgttgagcacaaatccagttttgtaagttggaagaaaggaggaatggttaagaggcattggccagggatacagcagaacttattaaagaagattttattttcagttcctttgatgcatggtggttgtactcataggtcccagaaagaaatttgcagaaaatattgtcctgtaacaatggaaagtgataatttctgtgaagagcatatttcatcagataagagaacagagaacgaaaaatttatggtgctaaggtcaatggttccatatatcagtgaggttgacaaagcatcaattctcagtgacacaattaagtacttgaaaaagcttgaggcaagagtagaggagttggaatcttgcatgtactcagttgattctgagccaaggccaaagagaaattacacagagatggtggagcagacatctgataactatgacaacaaaaagcttgataaccacaagaagccttggataaacaagaggaaggcttgcgacattgatgaaactgacccagaacttaataaatttgttccaaaagatggcctggctgatgtaaaagtcagcatccaagagatggatgttctaattgagatgagatgtccctctagagaatatatattgctcgatatcatggatgctataaacaacctgcacttggatgcctattcagtggtatcgtcaaatcttgatggagttctcacattggcccttaaatctacgtttcggggagcagccattgcaccagccgggataatcgaacaagctctttggaagatcgctggtaagtgt

SEQ ID NO: 1038 - protein, 656 aa, Citrus clementina
  clementine0.9_004500m  polypeptide
MASAAQNQEGVPEILRKQLAVAVRSIQWSYAIFWSLSAAQQGVLEWGDGYYNGDIKTRKTMQAMELTPDKIGLQRSKQLRELYESLLKGESELAYKRPSAALSPEDLTDAEWYYLVCMSFVFSSGQGLPGRALANSETIWLCNAQCADSKVFSRSLLAKSASIQTVICFPHLDGVIELGVTELVPEDPSLLQHIKASLLDFSKPFCSEKSSSPPYDEDDDSDPLCAKVSHEILDTVALESLYSPGEENKFDGEGVYELHGNINEELHLDSADECSKGCEHNHQTEESFMVDGINGAASQVQSWHFVDDDLSNGIPDSMHSSDHKSESLVNQAEGFPSSKDENMSHIQLKELQEGNHTKLSLLDLGIVDGAHYRKTLSAIFGSSNRLTENPCFLSVEHKSSFVSWKKGGMVKRHWPGIQQNLLKKILFSVPLMHGGCTHRSQKEICRKYCPVTMESDNFCEEHISSDKRTENEKFMVLRSMVPYISEVDKASILSDTIKYLKKLEARVEELESCMYSVDSEPRPKRNYTEMVEQTSDNYDNKKLDNHKKPWINKRKACDIDETDPELNKFVPKDGLADVKVSIQEMDVLIEMRCPSREYILLDIMDAINNLHLDAYSVVSSNLDGVLTLALKSTFRGAAIAPAGIIEQALWKIAGKC

SEQ ID NO: 1039 - DNA, 1791 bp, Citrus clementina
  clementine0.9_005551m
atgcaattttctggtcattatcagctgcacaacaagggtttacaaaggagtaagcaactaagagagctttacgagtctttgctgaaaggagaatctgagctggcttataagaggccttctgctgcattgtctccagaagatcttactgatgcagagtggtattacttggtttgcatgtcctttgtattcagttctggccaaggtttgccaggaagagcacttgcaaacagtgaaacaatctggttatgcaatgctcagtgtgcagatagtaaagtattctctcgctctttattggccaagagtgcatctattcagactgtcatatgctttcctcatcttgatggtgtaattgaacttggagtcactgaactggtcccagaggatcctagtctccttcaacatatcaaagcctcattattagacttctcaaagcctttttgctctgagaaatcttcctctcctccttacgatgaagatgatgacagtgaccctctgtgtgccaaggttagccatgagatattggatacagtggctttggagagcctatattctcccggagaagaaaacaaatttgatggggagggagtttatgaactacatggaaacatcaatgaagaattgcacttagattctgctgatgaatgctcaaagggctgtgagcacaatcaccagacagaagaatccttcatggttgatggtataaatggtgcagcttctcaagttcagagttggcattttgtagatgatgacctcagcaatggtattccagactccatgcattctagtgaccataaatctgaatctctcgtgaatcaagcagagggttttccttcttccaaggatgaaaacatgagccacattcaattgaaagaacttcaagaaggcaatcatacaaaactaagtttgttggatcttgggatagttgatggtgcacactacaggaaaactctttctgctatttttggaagttcaaatcggttgactgagaacccgtgtttccttagtgttgagcacaaatccagttttgtaagttggaagaaaggaggaatggttaagaggcattggccagggatacagcagaacttattaaagaagattttattttcagttcctttgatgcatggtggttgtactcataggtcccagaaagaaatttgcagaaaatattgtcctgtaacaatggaaagtgataatttctgtgaagagcatatttcatcagataagagaacagagaacgaaaaatttatggtgctaaggtcaatggttccatatatcagtgaggttgacaaagcatcaattctcagtgacacaattaagtacttgaaaaagcttgaggcaagagtagaggagttggaatcttgcatgtactcagttgattctgagccaaggccaaagagaaattacacagagatggtggagcagacatctgataactatgacaacaaaaagcttgataaccacaagaagccttggataaacaagaggaaggcttgcgacattgatgaaactgacccagaacttaataaatttgttccaaaagatggcctggctgatgtaaaagtcagcatccaagagatggatgttctaattgagatgagatgtccctctagagaatatatattgctcgatatcatggatgctataaacaacctgcacttggatgcctattcagtggtatcgtcaaatcttgatggagttctcacattggcccttaaatctacgtttcggggagcagccattgcaccagccgggataatcgaacaagctctttggaagatcgctggtaagtgt

SEQ ID NO: 1040 - protein, 597 aa, Citrus clementina
  clementine0.9_005551m  polypeptide
MQFSGHYQLHNKGLQRSKQLRELYESLLKGESELAYKRPSAALSPEDLTDAEWYYLVCMSFVFSSGQGLPGRALANSETIWLCNAQCADSKVFSRSLLAKSASIQTVICFPHLDGVIELGVTELVPEDPSLLQHIKASLLDFSKPFCSEKSSSPPYDEDDDSDPLCAKVSHEILDTVALESLYSPGEENKFDGEGVYELHGNINEELHLDSADECSKGCEHNHQTEESFMVDGINGAASQVQSWHFVDDDLSNGIPDSMHSSDHKSESLVNQAEGFPSSKDENMSHIQLKELQEGNHTKLSLLDLGIVDGAHYRKTLSAIFGSSNRLTENPCFLSVEHKSSFVSWKKGGMVKRHWPGIQQNLLKKILFSVPLMHGGCTHRSQKEICRKYCPVTMESDNFCEEHISSDKRTENEKFMVLRSMVPYISEVDKASILSDTIKYLKKLEARVEELESCMYSVDSEPRPKRNYTEMVEQTSDNYDNKKLDNHKKPWINKRKACDIDETDPELNKFVPKDGLADVKVSIQEMDVLIEMRCPSREYILLDIMDAINNLHLDAYSVVSSNLDGVLTLALKSTFRGAAIAPAGIIEQALWKIAGKC

SEQ ID NO: 1041 - DNA, 1788 bp, Citrus clementina
  clementine0.9_005579m
atgcaagcaatggaacttacacctgataaaataggtttacaaaggagtaagcaactaagagagctttacgagtctttgctgaaaggagaatctgagctggcttataagaggccttctgctgcattgtctccagaagatcttactgatgcagagtggtattacttggtttgcatgtcctttgtattcagttctggccaaggtttgccaggaagagcacttgcaaacagtgaaacaatctggttatgcaatgctcagtgtgcagatagtaaagtattctctcgctctttattggccaagagtgcatctattcagactgtcatatgctttcctcatcttgatggtgtaattgaacttggagtcactgaactggtcccagaggatcctagtctccttcaacatatcaaagcctcattattagacttctcaaagcctttttgctctgagaaatcttcctctcctccttacgatgaagatgatgacagtgaccctctgtgtgccaaggttagccatgagatattggatacagtggctttggagagcctatattctcccggagaagaaaacaaatttgatggggagggagtttatgaactacatggaaacatcaatgaagaattgcacttagattctgctgatgaatgctcaaagggctgtgagcacaatcaccagacagaagaatccttcatggttgatggtataaatggtgcagcttctcaagttcagagttggcattttgtagatgatgacctcagcaatggtattccagactccatgcattctagtgaccataaatctgaatctctcgtgaatcaagcagagggttttccttcttccaaggatgaaaacatgagccacattcaattgaaagaacttcaagaaggcaatcatacaaaactaagtttgttggatcttgggatagttgatggtgcacactacaggaaaactctttctgctatttttggaagttcaaatcggttgactgagaacccgtgtttccttagtgttgagcacaaatccagttttgtaagttggaagaaaggaggaatggttaagaggcattggccagggatacagcagaacttattaaagaagattttattttcagttcctttgatgcatggtggttgtactcataggtcccagaaagaaatttgcagaaaatattgtcctgtaacaatggaaagtgataatttctgtgaagagcatatttcatcagataagagaacagagaacgaaaaatttatggtgctaaggtcaatggttccatatatcagtgaggttgacaaagcatcaattctcagtgacacaattaagtacttgaaaaagcttgaggcaagagtagaggagttggaatcttgcatgtactcagttgattctgagccaaggccaaagagaaattacacagagatggtggagcagacatctgataactatgacaacaaaaagcttgataaccacaagaagccttggataaacaagaggaaggcttgcgacattgatgaaactgacccagaacttaataaatttgttccaaaagatggcctggctgatgtaaaagtcagcatccaagagatggatgttctaattgagatgagatgtccctctagagaatatatattgctcgatatcatggatgctataaacaacctgcacttggatgcctattcagtggtatcgtcaaatcttgatggagttctcacattggcccttaaatctacgtttcggggagcagccattgcaccagccgggataatcgaacaagctctttggaagatcgctggtaagtgt

SEQ ID NO: 1042 - protein, 596 aa, Citrus clementina
  clementine0.9_005579m  polypeptide
MQAMELTPDKIGLQRSKQLRELYESLLKGESELAYKRPSAALSPEDLTDAEWYYLVCMSFVFSSGQGLPGRALANSETIWLCNAQCADSKVFSRSLLAKSASIQTVICFPHLDGVIELGVTELVPEDPSLLQHIKASLLDFSKPFCSEKSSSPPYDEDDDSDPLCAKVSHEILDTVALESLYSPGEENKFDGEGVYELHGNINEELHLDSADECSKGCEHNHQTEESFMVDGINGAASQVQSWHFVDDDLSNGIPDSMHSSDHKSESLVNQAEGFPSSKDENMSHIQLKELQEGNHTKLSLLDLGIVDGAHYRKTLSAIFGSSNRLTENPCFLSVEHKSSFVSWKKGGMVKRHWPGIQQNLLKKILFSVPLMHGGCTHRSQKEICRKYCPVTMESDNFCEEHISSDKRTENEKFMVLRSMVPYISEVDKASILSDTIKYLKKLEARVEELESCMYSVDSEPRPKRNYTEMVEQTSDNYDNKKLDNHKKPWINKRKACDIDETDPELNKFVPKDGLADVKVSIQEMDVLIEMRCPSREYILLDIMDAINNLHLDAYSVVSSNLDGVLTLALKSTFRGAAIAPAGIIEQALWKIAGKC

SEQ ID NO: 1043 - DNA, 1932 bp, Eucalyptus grandis
  Eucgr.D02287.1
atggctactggcgtagaaggcaatgaaggtgtcccagcaaacctgagaaagcagcttgctgtggctgtgaggagtatccaatggagctacgcaattttctggacactatcagctacaaaacaaggtgtactgcaatggggtgatggctactacaatggggacatcaagaccaggaagacggtccaagccgtggagcttaaacctgataagattggtttacagaggagtgagcaattaagagatctttacgagtcgctgcttgaaggggaaactgatgcacaaaacaagcggccctcggctgcattatctccagaggatctcacagacgaagagtggtattacttggtttgcatgtcctttgtattcaatcctggcgaaggtcttccgggaagagcgctagcggatggccaaactatctggttatgcaatgctcaatatgcagatagcaaagtgttttctcgctcactacttgcaaagagtgcatctattcagactgtggtatgttttccctatctcggaggtgtgattgaacttggcgtgaccgagctggtcccagaggaccccagtctcctgcaacatatcaaagtttctttactagatttctccaagccaatttgttctgagaaatcttcctctataccacaaaatggagatgctgataaagagcctatgtgtgccaaggtcgactgtggcatggtggatgagttggttttggagaacctatattcaccggctcaagaaattaaatttgacccagagaaaataagtgaattttgtgaaagtatcccgaaagaactggatatggactctcctgatgagtgttctaatgggtgtgaacacaattaccaaacagaagattcgtttatggttgatggtatgaacggaggggcatcacaagttcaaagttggcattttgttgatgatgacttcagtaatggtgttcaaggttcaataaactctagtgattgtatatccgaagctattgtgaaccaagacaagtatatttcatctccaaggcgagaaaatgccaagaattcccacttgaaagaacttcaagaatgcaaccactcaaaattaagctccctggatcttggacctgacgacatctcgcattacagaagaacaatttctgctgttctaaggaaccctgatcaattgcctgagacacggtgtatctgcagctgtggatgcaaatccagctttctgaggtggaggatggttgaagttcataaaccgcgagcacaccaggaaactctgaagaagattttgttcgaagttccactgatgcaccgtggtcaagctcttaaatctgaactacagaatggtgtggaatcattgctgggagatgttgatttttgcgctggccacatattgtctaccaagaaaaaagaacatgaaaagtttctggtcctgaggtccatgattccttccatcgaggagatagataaagcatccatccttgatgacacaattatgtacctaagagagcttgaagcaagagtggaagaactagaatcttgcatggactcaacagaccttgaggggaaagttaccaggaaaaagtttccagacatgatagagcagacatccgataactgcaaaaaacgttggataaacaagaggaaggcctccgacattgatgaaaccgatgcagaacttgatagaaatgctcaaggagatgggcttcagacagatgtcaaagtcaacataaaggagcaggaagtatcgatcgagatgaaatgtccctatcgggagtacttgttgcttgatattctggaggcagtaaacaacctgcacttggatgcttattcaattcagtcatctacacttgatggtgttctcaaattaaccctcaagtctaagtttcgaggcgcagcagtatctccagctgggatggtcaaacaagtcctttggaagattactggaaagtac

SEQ ID NO: 1044 - protein, 644 aa, Eucalyptus grandis
  Eucgr.D02287.1  polypeptide
MATGVEGNEGVPANLRKQLAVAVRSIQWSYAIFWTLSATKQGVLQWGDGYYNGDIKTRKTVQAVELKPDKIGLQRSEQLRDLYESLLEGETDAQNKRPSAALSPEDLTDEEWYYLVCMSFVFNPGEGLPGRALADGQTIWLCNAQYADSKVFSRSLLAKSASIQTVVCFPYLGGVIELGVTELVPEDPSLLQHIKVSLLDFSKPICSEKSSSIPQNGDADKEPMCAKVDCGMVDELVLENLYSPAQEIKFDPEKISEFCESIPKELDMDSPDECSNGCEHNYQTEDSFMVDGMNGGASQVQSWHFVDDDFSNGVQGSINSSDCISEAIVNQDKYISSPRRENAKNSHLKELQECNHSKLSSLDLGPDDISHYRRTISAVLRNPDQLPETRCICSCGCKSSFLRWRMVEVHKPRAHQETLKKILFEVPLMHRGQALKSELQNGVESLLGDVDFCAGHILSTKKKEHEKFLVLRSMIPSIEEIDKASILDDTIMYLRELEARVEELESCMDSTDLEGKVTRKKFPDMIEQTSDNCKKRWINKRKASDIDETDAELDRNAQGDGLQTDVKVNIKEQEVSIEMKCPYREYLLLDILEAVNNLHLDAYSIQSSTLDGVLKLTLKSKFRGAAVSPAGMVKQVLWKITGKY

SEQ ID NO: 1045 - DNA, 1872 bp, Glycine max
  Glyma03g01180.1
atggctaacaacgggagtccaaagcatgagaagatgcaaaagaacctatgcacacagctagctgttgcagtgagaagcattcaatggagctatggtattttctggtcaccttcaaccactgaagaaagggtattggaatggagggaaggctactacaatggagacattaaaacaagaaagacagtgcaagccacggaattggaaataaaggctgataaaataggcctgcagaggagtgagcaactgaaggaactgtacaagtttcttcttgcaggtgaagctgatcatccacaaactaaaaggccttctgttgcattagctccagaggacctctcagatttggagtggtattacttggtttgcatgtcctttgttttcaatcacaaccaaagtttgcctggaagagcactagaaattggtgacacagtctggttatgcaatgctcaacatgcggatagtaaagttttctctcgttctttgctagcaaagagtgcgacaattcagaccgtggtgtgttttccctatcagaaaggcgttattgagataggcacaactgaactggttgctgaggatcctagtctcattcaacatgtcaaggcttgcttcttagaaatctcaaagcctacatgctctgataaatcttcctctatccttgataagccacatgatgacaaatatccaacatgcaccaagggtgaccaaagggtgttagatacaatggctttagagaacccatgttctaatggttgtgagcaccatttccctatggatggatccatgattgaaggtatcaatggtgtgccatctcaagtgcattttgtgaatgatgatgccttggtcattggtgctcctgattcccttagttcttgtgattgtatgtctgaagcttctgagaatcaaggcaaggattccaagaatgtaggccaaactcaacttatggaacttcaagattgccataaaccaaagagaagctccttggatgtgggagctgatgaggacttgtgctacataagaacactttgtgctattttggggaactcatcaacttttaagccaaacccttatgctggtaactcaaattgcaaatctagttttgcaaaatggaagaaagggagagtttctgaaaggaagaggccaaaattgcaccaaagcatgttaaagaagactttgtttaaggtcccctttatgcacagaagttactcttctctcaagtcacaaaaagggaatgacagaatggagtggactagtaaattggaaaatgatgatcatggtttaatagggaaagcattctctgataagaaaagagaaattaaaaactttcaagttgtcaaatcaatggttccatcttctataagtgaggtggagaagatttcaattcttggggacacaattaagtacttgaaaaagcttgagacaagagtggaagagctagaatcatacatggaagttacaggtcctgaagcaagaaagaggagtaaatgccctgatgttctagagcagatgtcagataactatggcaccagaaagatttgcatgggaatgaagccttggatgaacaagaggaaggcttgtggtattgatgagatagacacagagctagaaagaattacttctgaagaagcaaaagctttggatgtgaaagtcaatgtgaaggatcaggaggttctgattgagatgaaatgtccttacaggaaatacatactgtatgatatcatggataccattaacaacctacatttagatgctcagacagttgaatcttcaacaagtgatggtgttctcacattgacacttaaatctaagtttcgaggagcagcaacagcaccaatgaggatgatcaaagaagcgctgtggaaagtatctggaaatatt

SEQ ID NO: 1046 - protein, 624 aa, Glycine max
  Glyma03g01180.1  polypeptide
MANNGSPKHEKMQKNLCTQLAVAVRSIQWSYGIFWSPSTTEERVLEWREGYYNGDIKTRKTVQATELEIKADKIGLQRSEQLKELYKFLLAGEADHPQTKRPSVALAPEDLSDLEWYYLVCMSFVFNHNQSLPGRALEIGDTVWLCNAQHADSKVFSRSLLAKSATIQTVVCFPYQKGVIEIGTTELVAEDPSLIQHVKACFLEISKPTCSDKSSSILDKPHDDKYPTCTKGDQRVLDTMALENPCSNGCEHHFPMDGSMIEGINGVPSQVHFVNDDALVIGAPDSLSSCDCMSEASENQGKDSKNVGQTQLMELQDCHKPKRSSLDVGADEDLCYIRTLCAILGNSSTFKPNPYAGNSNCKSSFAKWKKGRVSERKRPKLHQSMLKKTLFKVPFMHRSYSSLKSQKGNDRMEWTSKLENDDHGLIGKAFSDKKREIKNFQVVKSMVPSSISEVEKISILGDTIKYLKKLETRVEELESYMEVTGPEARKRSKCPDVLEQMSDNYGTRKICMGMKPWMNKRKACGIDEIDTELERITSEEAKALDVKVNVKDQEVLIEMKCPYRKYILYDIMDTINNLHLDAQTVESSTSDGVLTLTLKSKFRGAATAPMRMIKEALWKVSGNI

SEQ ID NO: 1047 - DNA, 1950 bp, Glycine max
  Glyma07g07740.1
atggccaacaacgggagtccaaagcataagaagatgcaaaagaacctatgcacacaactagctgttgcagtgagaagcactcaatggagctatggtattttctgggcaccttcaaccactgaagaaagggtattggaatggagggaagggtactataatggagacattaagacaagaaagacagtccaagccatggaattggaaatgaaggctgataaaataggactgcagaggagtgagcaactgaaggaactgtacaagtttcttcttgcaggtgaagctgatccacaaactaaaaggccttctgctgcattagctccagaggacctctcagatttggagtggtattacttggtttgcatgtcctttgttttcaatcacaaccaaagtttgcctggaagagcactagaaattggtgacactgtctggttatgcaatgctcaacatgctgatagtaaaattttctctcgttctttgctagcaaagaccgtggtgtgttttccctatcagaaaggcgttattgagataggcacaactgaactggttactgaggatcctagtctcatacaacatgtcaaggcttgcttcttagaaatctcaaagcctacatgctctgataaatcttcctctgtccttgataagccacatgatgacaaatatccaacatgcaccaagggtgaccaaagggtgttagaagcaatggctctggagaacccatgttcccttgaagaaaatatcaaatttgatcatgaccccatcaatgaattgcaagatggcaacaacgaagattctaacatggattctcctgatggttttcattttgtgaatgaagccttagtcattggtgctccagattctttgagttcttgtgattgtatgtctgaggcttctgagaaccaaggcaatgattccaagaatgtagaccaaactcaacttatggaacttcaatattgccataaaccaaagagaagctccatggatgttggagctgatgaggacttgtgctacataagaacactttgtgctattttggggaactcatcaacttttaaaccaaacccttatgctggtaactcaaattgcaaatctagttttgcgaaatggaagaaagggagagtttctgaaaggaagaggccaaagttgcaccaaagcatgttaaagaagactttgtttaatgtcccttttatgcatagaagttactcttctctcaagtcacaaaaagagaatggcagaatgaaatggactagtaaattggaaaatgctaatgatggtttcatggagaaaacattctctgataagaaaagagaaaataaaaactttcatgttgtcaaaccaatggttccatcttctataagtgaggtagaaaaaatttcaattcttggagacacaattaagtacttgaaaaagcttgagacaagagtggaagagctagaatcttacatggaagttacagaccctgaagcaagaatcaggagaaaatgccctgatgttccagagcagatgtcagataactatggcaccagaaagatttgcatgggaatgaaaccttgggtgaacaagaggaaggcttgtggtattgatgagatagacacagagctagaaagaattgtttctgaagaatcaaaggttttggatgtgaaagtcaatgtgaaggagcaggaggttctgattgagatgaaatgtccttacagggaatacatactgtatgacatcatggataccattaacaacctacatttagatgctcaaacagttgaatcatcaacaagtgatggtgttctcacattgacacttaaatctaagaaagtcttacttggaatttcgaggagcagcaacagcaccaacgaggatgatcaaagaagcactctggaaagtatctggaaatacttgacatgcctatttggatttcacatgatagtattagtagtagtaatagtaaatatttatgat

SEQ ID NO: 1048 - protein, 650 aa, Glycine max
  Glyma07g07740.1  polypeptide
MANNGSPKHKKMQKNLCTQLAVAVRSTQWSYGIFWAPSTTEERVLEWREGYYNGDIKTRKTVQAMELEMKADKIGLQRSEQLKELYKFLLAGEADPQTKRPSAALAPEDLSDLEWYYLVCMSFVFNHNQSLPGRALEIGDTVWLCNAQHADSKIFSRSLLAKTVVCFPYQKGVIEIGTTELVTEDPSLIQHVKACFLEISKPTCSDKSSSVLDKPHDDKYPTCTKGDQRVLEAMALENPCSLEENIKFDHDPINELQDGNNEDSNMDSPDGFHFVNEALVIGAPDSLSSCDCMSEASENQGNDSKNVDQTQLMELQYCHKPKRSSMDVGADEDLCYIRTLCAILGNSSTFKPNPYAGNSNCKSSFAKWKKGRVSERKRPKLHQSMLKKTLFNVPFMHRSYSSLKSQKENGRMKWTSKLENANDGFMEKTFSDKKRENKNFHVVKPMVPSSISEVEKISILGDTIKYLKKLETRVEELESYMEVTDPEARIRRKCPDVPEQMSDNYGTRKICMGMKPWVNKRKACGIDEIDTELERIVSEESKVLDVKVNVKEQEVLIEMKCPYREYILYDIMDTINNLHLDAQTVESSTSDGVLTLTLKSKKVLLGISRSSNSTNEDDQRSTLESIWKYLTCLFGFHMIVLVVVIVNIYD

SEQ ID NO: 1049 - DNA, 1962 bp, Populus trichocarpa
  POPTR_0002s16080.1
atggctcatgttgtccaaagccagcaggcaatactagagaagctgaggaaacagcttgcaattgctgtgaggagtgtacagtggagctacgcaattttctggtcactgtcaaccagacagaaaggggtactggaatggggtggtgggtactacaatggggacatcaagactaggaaagttcaagccacggaacttaaagctgataaaataggcttacagaggagtgagcaattgcgagaactttacaagtctctccttggaggcgatgctggccagcaggctaagaggtcttctcctgcattgtctcctgaggatctgtcagatgaggagtggtattacttggtgtgcatgtcctttgtattcaatcctggtgaagggttgccaggaagagcattggccaataaacagaccatctggttgtgcaatgctcaatatgcagatagcaaagtattctctcgctctttgcttgcaaagagtgcatctattcagaccgtggtgtgttttccctatcttgagggagtgatggagctaggtgtaactgagctggtcacagaagaccccagtctcattcaacatatcaaagcttccttattagatttctcaaagcctgattgctctgagaaatcttcctctgctgctcataatggagatgatgatgaagacccaatgtctaccaagatcagccatgagatagttgattcattagttttggagaacctgtacaccccaacagacgatatagaacttgagcaagagggaattaacgatttacatggaaatttgcgtgaagaattcaaaaggaattctcctgatgattgttcagatggctgtgagcacaatcaccagactgaagactccatgcatgaaggtttaaatggaggtgtttctcaagttcaaagttggcatttcatggatgatgaattcagcgatgatgttctagattctatgaattcgagtgagtgcatatcagaggctgtagtgaaacaaggaaaggccgtactctcttccaaggaaaaaaatgtaacccgccttcagtcgcaagtatttcaagaaggaaaccacacaaagttgagctccttcgatcttggagctgatgatgacttgcactacagaagaactgtgtgtgttattatgaaaagttcaagtcaatcaattgaaaatccatgtttccgaagtggagatcacaagtccagtttttttagctggaagaaaagagcagttgatggcgttatgccacgggtacaacagaatatgttgaagaagattttatttgcagtacctttgatatatggtggccactctcttaggttcgacaaggaaaatggaggaacagattgcctcaagaaattggaaggctgtgaaacgtgcaaggagcattataaatcagataaacaaagagtgaatgacaaatttatagtactcaggtcgatggttccttctattagtgagattgacaaagaatcaatcctcagcgacaccattaactacttgaaacagcttgaatcaagagtagcagaactagaatcttgcaaaggctggatagatcacgaggcaggacacaggaggagttacatggacatggtagaccagacatcagataacgacgacatcaagaagattgacaatggaaagagatcttgggtaaacaagaggaaggcccttgacattgatgaagctgaactagagcttgatggggtttctcccaaagatgggatgcccttagatttgaaagtatgcacgaaagagaaggaggttctcattgagattagatgtccttacagggagtacatgttgcttgatatcatggatgaaatcaacaaactgcagttggatgtgcactcagtccagtcatccactcttgatggcattttcgcattgaccctgaaatctaagtttagaggggcagcagttgcaccagcagggatgatcgaacaagcactttggaaaattgccggcaagact

SEQ ID NO: 1050 - protein, 654 aa, Populus trichocarpa
  POPTR_0002s16080.1  polypeptide
MAHVVQSQQAILEKLRKQLAIAVRSVQWSYAIFWSLSTRQKGVLEWGGGYYNGDIKTRKVQATELKADKIGLQRSEQLRELYKSLLGGDAGQQAKRSSPALSPEDLSDEEWYYLVCMSFVFNPGEGLPGRALANKQTIWLCNAQYADSKVFSRSLLAKSASIQTVVCFPYLEGVMELGVTELVTEDPSLIQHIKASLLDFSKPDCSEKSSSAAHNGDDDEDPMSTKISHEIVDSLVLENLYTPTDDIELEQEGINDLHGNLREEFKRNSPDDCSDGCEHNHQTEDSMHEGLNGGVSQVQSWHFMDDEFSDDVLDSMNSSECISEAVVKQGKAVLSSKEKNVTRLQSQVFQEGNHTKLSSFDLGADDDLHYRRTVCVIMKSSSQSIENPCFRSGDHKSSFFSWKKRAVDGVMPRVQQNMLKKILFAVPLIYGGHSLRFDKENGGTDCLKKLEGCETCKEHYKSDKQRVNDKFIVLRSMVPSISEIDKESILSDTINYLKQLESRVAELESCKGWIDHEAGHRRSYMDMVDQTSDNDDIKKIDNGKRSWVNKRKALDIDEAELELDGVSPKDGMPLDLKVCTKEKEVLIEIRCPYREYMLLDIMDEINKLQLDVHSVQSSTLDGIFALTLKSKFRGAAVAPAGMIEQALWKIAGKT

SEQ ID NO: 1051 - DNA, 1947 bp, Populus trichocarpa
  POPTR_0014s07960.1
atggctcctgttgtccaaggccagcaggtggtgccagataacttgaggaaacagctcgcagttgctgtaaggagtgtgcagtggagttacgcagttttctggtcacagtcaactagacaacaaggggtactggaatggggtgatgggtactacaatggagacatcaagactaggaaagttgaagctatggagcttaaagctgataaaataggcttacagagaagtgagcaattgagagaactttacgagtctctccttgaaggtgagaccggcctgcaggctacgaggtcttctcctgcattgtctccagaggacctgtcagatgaagagtggtattacttggtttgcatgtcctttgttttcaatcctggtgaagggttgccaggaagagcattagctaataaacagcctatctggttgtgcaatgctcaatatgcagatagcaaagtattctctcgctctttactcgcaaagagcgcatcaattcagactgtggtgtgttttccctatcttgagggagtaatagagctaggtgtgactgagctggtcacagaagaccccggtctcattcagcatatcaaagcctccttattagacttctcaaagcctgtttgttctgataaatcgttctctgctgctcataacaaggatgatgataaagacccaatgtctaccaggatcagccatgagatagttgatacattggctttggagaatctgtacaccccaacagaagatatagaatctgagcaggagggaattaactacttacatggaaatgtgtgtgaagaattcaacaggaactctcctgatgatttctcaaatggctatgagcacaatctggtgactgaagactccttcatgcttgaagatttaaaggaaggagcatctcaagttcaaagttggcattccatggatgatgaattcagcgatgatgttagagattctatgaattcaagtgattgcatatcagaggtttttgtgaagcaaggaaaggttgtaccctcttccaagggaaaagacatatcccacctgcaattgaaagtacttcaagaaggaaaccacacaaaattgagctccttagatcctggagctgatgatgacttgcactacagaagaactgcatttgttattctgaaaagctcaagtcagttgatcgaaaatccatgtttccaaagtggtgattacaaatccagttttgttggttggaagaaaggagcagctgatggctataagccacgaatacaacagaagatgttgaaaaagattttatttgcagcacctttgatgcatggtggtcactctattaggtctgacaaggaaaatgcaggaaaagattgcctcaagaatttggaaggctgtgaaacatgcaagttgcattttgaatcagaaaaacaaaaggagaatgaaaaatatctagcactcgagtcaatagttgcttctattaatgagattgacaaagcatcaatcctcagcgacaccattaattacccgagacagcttgagtcaagagtagcagaactggaatcttgcacaggctcgacagattatgaggccagatccaggagttacatgggcatggtagaccggacatcagataatcacggcatcaagaagccttggataaacaagaggaaggcccgtgacattgatgaagctgaactagagcttgatgaggttgctcccaaggatggcatgcccgtagatttgaaagtatgcatgaaagagaaggagattctcatcgagatgagatgtccttacagggagtacatgttgctcgatatcttggatgaagccaacaaacggcagttggatgtgctttcggttcattcatccactcttgatggcattttcacgttgaccctgaaatctaagtttagaggggcagcgccagtttcaccagaagggatgatcaaacaagcacttcggaaaactgtcggcaagact

SEQ ID NO: 1052 - protein, 649 aa, Populus trichocarpa
  POPTR_0014s07960.1  polypeptide
MAPVVQGQQVVPDNLRKQLAVAVRSVQWSYAVFWSQSTRQQGVLEWGDGYYNGDIKTRKVEAMELKADKIGLQRSEQLRELYESLLEGETGLQATRSSPALSPEDLSDEEWYYLVCMSFVFNPGEGLPGRALANKQPIWLCNAQYADSKVFSRSLLAKSASIQTVVCFPYLEGVIELGVTELVTEDPGLIQHIKASLLDFSKPVCSDKSFSAAHNKDDDKDPMSTRISHEIVDTLALENLYTPTEDIESEQEGINYLHGNVCEEFNRNSPDDFSNGYEHNLVTEDSFMLEDLKEGASQVQSWHSMDDEFSDDVRDSMNSSDCISEVFVKQGKVVPSSKGKDISHLQLKVLQEGNHTKLSSLDPGADDDLHYRRTAFVILKSSSQLIENPCFQSGDYKSSFVGWKKGAADGYKPRIQQKMLKKILFAAPLMHGGHSIRSDKENAGKDCLKNLEGCETCKLHFESEKQKENEKYLALESIVASINEIDKASILSDTINYPRQLESRVAELESCTGSTDYEARSRSYMGMVDRTSDNHGIKKPWINKRKARDIDEAELELDEVAPKDGMPVDLKVCMKEKEILIEMRCPYREYMLLDILDEANKRQLDVLSVHSSTLDGIFTLTLKSKFRGAAPVSPEGMIKQALRKTVGKT

SEQ ID NO: 1053 - DNA, 1917 bp, Vitis vinifera
  GSVIVT01026927001
atggctaatggggtccaaaaccaggaaggggttccagaaaacctaagcaaacagcttgctgtggctgtgaggagtatccagtggagctatgctattttctggtcattgtcaaccaggcaacaaggggtactggaatggagtggggggtactataatggggacattaagacaaggaagacagtccaggaaatggaacttaaagccgacaaaatgggcttacagaggagtgagcaattgagagagttgtacgagtctctcttagaaggtgaaaccgaccaacagtccaagaggccttctgctgcattgtctccagaagatctctcagatgcagagtggtattacttggtttgcatgtcctttgtattcaatcctggcgaaggtttgccaggaagagcactagcaaatggtcaatccatctggctttgtgatgctcaatatgcggatagcaaagttttctctcggtctttgctagcgaagagcgcgtctattcagacagtggtatgttttcctcatatggggggtgtgattgagctaggcgttacagagctggtcccagaggatcctagtctcattcaacatatcaaagcttgtttactcgagctttcaaagcctatctgctctgagaaatcttcctttgttccttgtaacactgatgatgataaagaccgcatgtgtgccaaggttgatcatgatatagaggggatgagtgaattgcacggaaacatccatgaagaacataacattggttctcctgatgactgttcaaatggttgtgaggatgatcaccagacagaggactccttcatgcttgaaggtattaatggaggtgcttcccaagttcagagttggcatttcgtggacgatgatttcagcaatggtgttcaaggttccatggattctagtgactgtatatcacaagcttttgtgaaccaagaaaggattcactcttcccccaagggtgaaaatgtaaacaatgttcgactgaaagaccttcaagaatgcaatgacacaaaatttagctccttggatcttggagctgatgatgatttgcactacagaagaactatttctactgttctcaggaagtcacacccgttgattggaaattcatgttttcgctgttatgatatcaaatctagctttataacctggaagaaaggaggaatgcttgatgcccaaaagccacaaacacaacaaagaatattaaagaagatcttgtttacggtccccttgatgcatggtggttgcggtttcaagtcccaaaaagaaaatgctggaagagatgggctttggaaatctggaagtgatggcatctgcaagcaacatgctttatcagataaaaaaagagagaaagagaagtttctggttctcaggtcaatggttccttctatcaacaagatcgatgaagtatcaattctcggtgacacaatagagtacctgaaaaagcttgaggcaagagtagaagagttggaaactagtatggacttgcagacagagctggaagcaagagctagacagaaatacctggatatggtagaacagacatcagacaattatgatgacaaaatgattgatgatggaaagaagctgtggataaacaagaggaaggcttgtgacattgatgaaactgacctggaaatcaatgaaatcattcctaaagacagcctgccatcatcagacatgaaagtccgcataaatgagcaggaggtactcattgagatgagatgcccttggagagaatacttattgcttgatatcatggatgccataaacaacctccacttggattgtcactcagttcaatcatcaaaccatgacggttttctcactttaacacttaaatccaagtttcgaggacgagcagtggcatcagcagggatgatcaaacaggcactatggaggataacaagcaaatgc

SEQ ID NO: 1054 - protein, 639 aa, Vitis vinifera
  GSVIVT01026927001  polypeptide
MANGVQNQEGVPENLSKQLAVAVRSIQWSYAIFWSLSTRQQGVLEWSGGYYNGDIKTRKTVQEMELKADKMGLQRSEQLRELYESLLEGETDQQSKRPSAALSPEDLSDAEWYYLVCMSFVFNPGEGLPGRALANGQSIWLCDAQYADSKVFSRSLLAKSASIQTVVCFPHMGGVIELGVTELVPEDPSLIQHIKACLLELSKPICSEKSSFVPCNTDDDKDRMCAKVDHDIEGMSELHGNIHEEHNIGSPDDCSNGCEDDHQTEDSFMLEGINGGASQVQSWHFVDDDFSNGVQGSMDSSDCISQAFVNQERIHSSPKGENVNNVRLKDLQECNDTKFSSLDLGADDDLHYRRTISTVLRKSHPLIGNSCFRCYDIKSSFITWKKGGMLDAQKPQTQQRILKKILFTVPLMHGGCGFKSQKENAGRDGLWKSGSDGICKQHALSDKKREKEKFLVLRSMVPSINKIDEVSILGDTIEYLKKLEARVEELETSMDLQTELEARARQKYLDMVEQTSDNYDDKMIDDGKKLWINKRKACDIDETDLEINEIIPKDSLPSSDMKVRINEQEVLIEMRCPWREYLLLDIMDAINNLHLDCHSVQSSNHDGFLTLTLKSKFRGRAVASAGMIKQALWRITSKC

SEQ ID NO: 1055 - DNA, 1878 bp, Solanum lycopersicum
  Solyc08g081140.2.1
atggctatgggacaccaagatcaagatggagtcccaggcaacttgagaaagcaacttgctcttgctgttagaggcattcaatggagctatgcaatcttctggtcaactgcagttacacaaccaggggtgttgaaatggattgatgggtactataatggggatatcaagaccaggaagactgttcaggcgggggaagttaatgaagaccagctggggttgcatagaactgagcaattgaaagaactttatagttccctcttaacaagtgaaagtgaagaagacctgcagccacaggccaaaaggccgtcggcctcattatctccagaagatctcactgatacagagtggtatttcctagtatgcatgtcatttgtcttcaatgttggccaagggttaccagggaagaccttagcaacaaatgaaactgtttggctgtgcaacgctcaccaagccgagagtaaagtcttttctcgttctttgctagcaaagagtgcatctatccagactgttgtatgctttccctatttaggaggcgtaattgagctgggagtcaccgagcttgtcacggaagatcctaacctcattcagcaaataaaaaattcctttctagaggttgattactccgttattttgaagaggcctaattatgtctccaacgatgcaaaaaatgacacgaatatcggtagccaaaagcctgatcataatgcacttgaaaatgatgcttatccagttgaaataaattcacctcatgatagttcaaatggttttgtcgccaatcaagaggcagaagattcactgatggtggtagacggtattggggaaacttcacaagctcaaagctggaggttcatggatgataatatcagtaatggtgcgaataattccttgaattccagtgactgcatctctcaaaacaatgcaaattgtgaaaagttgtcccctctttcgagtggagagaaggaaactaagccttgcccactagaccgtcaagagaacgatcagaagaaaccgcatcttttagatcaccaaggagatgatgctcaatatcaagctgtcctttctactcttttaaagagttctgaccaattaactttgggaccacattttagaaatatgaataaaaagtcaagttttgctagttggaaaaccgatattcagatgccgagatttggaactgcacaaaaactattgaagaaggtacttcttgaagttcctagaatgcatgctggtgttatacataaattcagcagagaaaatggtaaaaagaatagcctttggagaccagaagttgatgacattgatagaaaccgtgttatttcagagagaaggcgaagagaaaagataaatgagagatttatgcatcttgcatcgatgctgccaactagtagcaaggttgacaaaatatcactactcgatgagacaatagaatacatgaaagagcttgaaaggagagttcaggagctggaggcgagatcagcaagacgatcaaatgatactgcagagcagacatctgataattgtggcactagcaaattcaatgacatcaggggatcactaccgaacaaaaggaaggcatgtgatatggatgaaatagaacctgaaagctccaatggattactgaaatgtagttcagctgatagtattgtcatcaatatgatcgataaggaagtctcgatcaagatgagttgtctttggagcgagagcttgttgcttaaaattatggaggcactgactgacctacatatggattgccatacagttcagtcttccaaccttgatgggattctatccattgctatcgaatccaagtcaaccggatcgaaaacactagcagtcggaacaattagagaagcacttcagagagtagtatggaaatct

SEQ ID NO: 1056 - protein, 626 aa, Solanum lycopersicum
  Solyc08g081140.2.1  polypeptide
MAMGHQDQDGVPGNLRKQLALAVRGIQWSYAIFWSTAVTQPGVLKWIDGYYNGDIKTRKTVQAGEVNEDQLGLHRTEQLKELYSSLLTSESEEDLQPQAKRPSASLSPEDLTDTEWYFLVCMSFVFNVGQGLPGKTLATNETVWLCNAHQAESKVFSRSLLAKSASIQTVVCFPYLGGVIELGVTELVTEDPNLIQQIKNSFLEVDYSVILKRPNYVSNDAKNDTNIGSQKPDHNALENDAYPVEINSPHDSSNGFVANQEAEDSLMVVDGIGETSQAQSWRFMDDNISNGANNSLNSSDCISQNNANCEKLSPLSSGEKETKPCPLDRQENDQKKPHLLDHQGDDAQYQAVLSTLLKSSDQLTLGPHFRNMNKKSSFASWKTDIQMPRFGTAQKLLKKVLLEVPRMHAGVIHKFSRENGKKNSLWRPEVDDIDRNRVISERRRREKINERFMHLASMLPTSSKVDKISLLDETIEYMKELERRVQELEARSARRSNDTAEQTSDNCGTSKFNDIRGSLPNKRKACDMDEIEPESSNGLLKCSSADSIVINMIDKEVSIKMSCLWSESLLLKIMEALTDLHMDCHTVQSSNLDGILSIAIESKSTGSKTLAVGTIREALQRVVWKS

SEQ ID NO: 1057 - DNA, 1629 bp, Vitis vinifera
  GSVIVT01019750001
atggatactgaaccccaaaatcaaggagtgccagagaacctaaggaaccagcttgcccttgctgttagaaacattcaatggagctatgcaatcttctggtcaatttcaactagacaaccaggggtactggagtggggagatgggtactacaatggagacatcaaaacaagaaaaaccgttcaggctgtggagttcaatgctgaccaaatggggttgcagagaagtgagcaattgagagaactttacgagtccctttcaataggtgaatccaacccacaacccagaaggcattctgcagcattatcacctgaagacctcacagatgcagagtggtattacttggtttgcatgtccttcgtgttcgatataggccaaggattgcccggaagaacattggctagtggccagcctatctggctatgcaatgctccttatgcagagagcaaagtgttcagccgctctctgctagcaaagagtgcatctatccagactgtggtatgctttccatatttaggaggtgtgatagagctgggtgcgactgaaatggttttggaggacccgagtctcatccaacacatcaaaacttcttttctggagattccataccccatgctgtccaggatatctaattccagaaagataagagaagacaaagaccctgcttctgcagagcttgatcataattttctcgacaccaaccttaatccagcagttttagaagatgaattcagtaactgtgtccataactcaatgaactctagtgactgcatatctcagaccatcatgaatcctgaaaagttgattttgggaccatgctttcgaaattccaataaggagtcaagcttcgttagttggaagaaaagaggattgatgggtactcagaagctgaacactggaacccaacaaaaattattgaagaaggtgctgtttgaagttgctcaaatgcatggtggttgcttaatgagctcccgggataataatggagataacgatgaaatttggagaccagaggctgacgaaatcactctgaaccatgtgttgtccgagaggaaacggagggaaaaaataaatgaaaggttctcggttctcagatcacttgttccttctattaaccaggtcaacaaagtgtctgtacttgatgacaccatagaatacctgaaagagctcaaaagaagagttgaagagttggaatctagcaaggagtcaacagaaatagaggcaagaacaagcaggagaaccccagatactgcagagaggacatctgataactatggcaacgacagagttggaaatggcaagaaacctttgttgaacaagaggaaggcttgtgacattgatgaaatggagcctgattccaaccgggttttactgaaagatgattcagctgaaaatataacagtcaatatgaacgagaaggatattctaatcgaactgaggtgtccatggagagagtgcttgttgcttgagatcatggatgctgtaagcaatctccatttagattctcagtcagttcagtcagccagcgttgatggaattctttctctgaccattaaatcaaagtttaagggatcatcatttgcatcagcagaaacaatcagacaagcacttcagagagttgtcccaaagtgt

SEQ ID NO: 1058 - protein, 543 aa, Vitis vinifera
  GSVIVT01019750001  polypeptide
MDTEPQNQGVPENLRNQLALAVRNIQWSYAIFWSISTRQPGVLEWGDGYYNGDIKTRKTVQAVEFNADQMGLQRSEQLRELYESLSIGESNPQPRRHSAALSPEDLTDAEWYYLVCMSFVFDIGQGLPGRTLASGQPIWLCNAPYAESKVFSRSLLAKSASIQTVVCFPYLGGVIELGATEMVLEDPSLIQHIKTSFLEIPYPMLSRISNSRKIREDKDPASAELDHNFLDTNLNPAVLEDEFSNCVHNSMNSSDCISQTIMNPEKLILGPCFRNSNKESSFVSWKKRGLMGTQKLNTGTQQKLLKKVLFEVAQMHGGCLMSSRDNNGDNDEIWRPEADEITLNHVLSERKRREKINERFSVLRSLVPSINQVNKVSVLDDTIEYLKELKRRVEELESSKESTEIEARTSRRTPDTAERTSDNYGNDRVGNGKKPLLNKRKACDIDEMEPDSNRVLLKDDSAENITVNMNEKDILIELRCPWRECLLLEIMDAVSNLHLDSQSVQSASVDGILSLTIKSKFKGSSFASAETIRQALQRVVPKC

SEQ ID NO: 1059 - DNA, 1911 bp, Eucalyptus grandis
  Eucgr.D01841.1
atggcaagtggaatggagaaccagggggaaattcctgcgaatttgaagaaacagcttgctctggctgtgagaaaaatccaatggagctacggaatcttctggtccatctcaaccagacagcctggggtcttggagtggggtgatgggtactacaatggagacatcaaaaccaggaaaacaattcaagctgtggaacttaatactgaccagattggtatgcagagaagcgagcaactgagggaactatatgagtctctatccgctggtgaatccagcccacaagttagaaggccttcagcagcattgtcccctgaagatctcactgacgcggagtggtattatttggtttgcatgtcgttcatctacgacattggccaagggttgccaggaagaacattaactacaggccagcctacctggctctgcaatgcccattatgcagatagcaaagtcttcactcgctctctattggcaaagagtgcatccattcagactgtggtgtgctttccatttcgagggggcgtgattgagcttggtgtgaccgaccaggtttcggaggaccctggtgtcatccatcaagtcaaaggtactcttctggaaatccaatacccaatagcttccaagaaattcagtgctcttattggagatacgatagaccaagacgatgttgatattctcgatcacgacattcttgatgtcaaattggttcctgtggcaagagaactggatatggcttctccagacaccagctcaaatggttttgaggccaatcagctaccggagaattcatttgtggttgaagtgataaatggagtagcttctcaagcacagagttggcagttcatggatgatgagtatagcaactgcttacaccattctgtgaactccagcgattgcatatcccaaaccatagttgaacctacaaacttaaggtcagtccaagaagatgacaaggcaaatgaccctcaaggatgtggttacgagaagccaaccatcttggagaatgaaattgatgatgtacattaccagagtgtcctttcatcgcttttgagaacgtcacaccagttgatcgttgggccacattttcaaaggggtaatagggagtcgagttttgtcgcttggaagaagggatggtttccatctcggcaaaccacacaaggtgggacaccgcaagaggtactgaagagaatcctatttcaagttccaaggatgtatgataatgctcttcagtcccccttagaagatggcggggaaaatggagtttggaggccggaggctgatgaaattggtctgaaccatgcaatattggaaaggaagcaaaaggaaaaaataaacgatcgcttgggtgtactgaaatccatggttccctcggtcagcaaggttgacaagctgtctatattagacgacaccattgcgtacctgagggagctccagaggaaggttgaagagttggaatcttgggggattgggatggaagtagaagcgaaatcgagaagaaagccccatgacatggtcgagcgaacttccgataactgcgggacccatgtgacaggctcaggcaagaagccggtcagaaacaagaggaaggccagcaacattgatagcatggagctggagaccaattctgtagtgcagagagatgtgtctgctgataatttgacagtcaagattaacgataggactgtgctaattgagatgcggtgctcttcgagagagggagtattgctcgagatcataaacgaggtgaacaatctccatttagattctcactcagttcagtcatcgaccatcgacgggattctgtccttgaccattaaatctaagttcacaggatcgacggtaatgtctgctgcaacaatcaaacaagcactatggagattcgctcggaaatgcggaaattcatctccatac

SEQ ID NO: 1060 - protein, 637 aa, Eucalyptus grandis
  Eucgr.D01841.1  polypeptide
MASGMENQGEIPANLKKQLALAVRKIQWSYGIFWSISTRQPGVLEWGDGYYNGDIKTRKTIQAVELNTDQIGMQRSEQLRELYESLSAGESSPQVRRPSAALSPEDLTDAEWYYLVCMSFIYDIGQGLPGRTLTTGQPTWLCNAHYADSKVFTRSLLAKSASIQTVVCFPFRGGVIELGVTDQVSEDPGVIHQVKGTLLEIQYPIASKKFSALIGDTIDQDDVDILDHDILDVKLVPVARELDMASPDTSSNGFEANQLPENSFVVEVINGVASQAQSWQFMDDEYSNCLHHSVNSSDCISQTIVEPTNLRSVQEDDKANDPQGCGYEKPTILENEIDDVHYQSVLSSLLRTSHQLIVGPHFQRGNRESSFVAWKKGWFPSRQTTQGGTPQEVLKRILFQVPRMYDNALQSPLEDGGENGVWRPEADEIGLNHAILERKQKEKINDRLGVLKSMVPSVSKVDKLSILDDTIAYLRELQRKVEELESWGIGMEVEAKSRRKPHDMVERTSDNCGTHVTGSGKKPVRNKRKASNIDSMELETNSVVQRDVSADNLTVKINDRTVLIEMRCSSREGVLLEIINEVNNLHLDSHSVQSSTIDGILSLTIKSKFTGSTVMSAATIKQALWRFARKCGNSSPY

SEQ ID NO: 1061 - DNA, 1689 bp, Eucalyptus grandis
  Eucgr.E00624.1
atgacacaagctatagaactcaatggaggagaccatatggacttgcatagaagtgaacagctacgagagctatatgaatccctctcggggagcgaacccaatccacaaactagtagaaggccttcagttgccttgtccccagaagatcttgccgatgcagaatggtattacttggtttgtatgtccttcatcttcaacattggccaatgtttgcctggacaaagtttagcaactggtaaactgatttggctatgcaatgcgcactgtgcagatagcaaagtgttcagtcggtctctgcttgctaagagcgcgtcaattcagactgttgtgtgcttcccctttttggatggcgtcattgagctaggcacaacagacccggttttggaagatcctaatctcattcaacatgtcaaaacttacctcttagagtcttcagacttgagaagatccgacccctgtgctagagacaatactgaagaaaccataatgatttcagtagaagcagaggaaggaataacttcacttaatcccaattcaaatgggcttgatcccaacccacaacttgatgactcgtgtattattggagaattatatggagttgcttctcaaatacaaagttggcagattaagaatgatgagctcagttaccacatccatcaatccggaaattccaaagactctacttcgcaatccttcttagaaactggaacagccattccaattcctaattttgagaagtccaaagatcattggccaggaaaccttcaagaatgcaataacgaagaactaaacagggtagaccttcgagctgacggtttgcactaccagactgctctgtcatctatcttgaaaacctccaacggattaagatcaggaccacatcgtgaatggggtgaaccagagtcaggtttcataggttggaagaaaggacaacacaaatggcagagggcaaaaggtgttccacagatgctgctgaagaagatcttgcttgaagtgcctcagctgcatgcgaggagcatgctcgacatttccaaagtaagttgcaagagagatgggttgtggatggctttgacagatgaactcagtccagaccacacactatctgaaagtaggcaaagggaaaagataaacgagcagttttctgttcttaactcaatcctcccattagtaaacaaggttgacaaaatatcaatactagacaacacaatcgaatacgtaaaggagcttcagagaagggcggaagaattggagtcaagtaggacgtcaaatggattactggcaatctctgaaggaaaaccccaagaaagtacagagaggacgtctgataactgtggcaatcccaggacgggtcttagcaagcagccaatagttaaaaaaaggaaagctcacaactgtggcacaacagaaacagataacgattatcttagagatattccaattgattatttaagtgttagcgtgaatgatgaagacgtgctaattgagatgaggtgtctttggagggaaggagtactgcttgagataattgaagctttgagccattctagattggattctcactcagttcagtcattgagcagcaacggtattctttccgtgaccattaaatgcaagttgcagagatcaacaacaacaaaaacaacagctgcaacgatcaaacaagcgcttcaaggagtcgctcagaactgc

SEQ ID NO: 1062 - protein, 563 aa, Eucalyptus grandis
  Eucgr.E00624.1  polypeptide
MTQAIELNGGDHMDLHRSEQLRELYESLSGSEPNPQTSRRPSVALSPEDLADAEWYYLVCMSFIFNIGQCLPGQSLATGKLIWLCNAHCADSKVFSRSLLAKSASIQTVVCFPFLDGVIELGTTDPVLEDPNLIQHVKTYLLESSDLRRSDPCARDNTEETIMISVEAEEGITSLNPNSNGLDPNPQLDDSCIIGELYGVASQIQSWQIKNDELSYHIHQSGNSKDSTSQSFLETGTAIPIPNFEKSKDHWPGNLQECNNEELNRVDLRADGLHYQTALSSILKTSNGLRSGPHREWGEPESGFIGWKKGQHKWQRAKGVPQMLLKKILLEVPQLHARSMLDISKVSCKRDGLWMALTDELSPDHTLSESRQREKINEQFSVLNSILPLVNKVDKISILDNTIEYVKELQRRAEELESSRTSNGLLAISEGKPQESTERTSDNCGNPRTGLSKQPIVKKRKAHNCGTTETDNDYLRDIPIDYLSVSVNDEDVLIEMRCLWREGVLLEIIEALSHSRLDSHSVQSLSSNGILSVTIKCKLQRSTTTKTTAATIKQALQGVAQNC

SEQ ID NO: 1063 - DNA, 1878 bp, Glycine max
  Glyma05g37770.1
atggtgccagagaacttgaagaaacaacttgctttggctgtgagaagcatccattggagctatgcaatcttctggactgattcaactacccaacccggggtgttgagctggggggaagggtattacaatggagacattaagactaggaaaacaagtcaaggagtagagctcaattctgaccaaatagggttgcagaggagtgaacagctgcgagaactattcaaatccctcaaaactgtagaagtcagccctcaaactaaaaggccttcagcagcactgtccccagaagatctcacagatgctgagtggtattacttggtttgcatgtccttcatattcaacattggccaagggttaccaggaagaactctagcgaagggtcaatccatttggctgaacaatgcccattctgctgattgtaaaatttttagccgttctcttctggcaaagacggttgtgtgctttccgtttagggaaggggttattgagctaggtactactgaacaggtctcagaagatttgagtgtcattgaacggatcaaaacttctttcttgaacagtctgcatgtcgatgttcccaataagtcagtagctacattgaaatcaaggaaacaggaagatctttcttatgtagcatttgatcataatgactataatgttgaatcgattccagaagttgggtatgaaatagccaacacaacctctcctaatggtagttcaaatgcaatccaagccaatcaaccactagatgacacacttatggttgaaagtataaccaatggcacttctcaagtccaaaactggcaagttattgatgatgaattgagtaactgtgtccataactccatgaattccagcgactgtatatcaccaacttttgccagccttgagaatattgcttctgcccccaagtgtaacaacccttctgatccttgtgcccgagattttcaaaagtgcaacaacccaaaaatgaccttagtggatcctcgaagtgatgagtggcattatcagagagttatttccacccttataaaaaacactgaccagttacttatgggaatgcatttgcaaaaatttcctcaggcatcaagctttgttagttggaggaaaggagagccaatggattcccaatggccaagagcaggaacctcacaaaagttattgaagaaagtattgtttgaagttcctcaaatgcacttggatgggcttcatgagtctcaagaagagaatgactataaagagggaatgagagtagaagctgatgaaaacggcatgaaccatgttatgtcagaaaggaggagaagagcaaaactaaatcaaaggtttttaacccttaggtcaatggtcccttcaatcagtaaggatgacaaagtttcgatactagatgatgcaattgaataccttaaaaagcttgagagaaggataaacgagttggaagctcacaggggtgtaacagatatagagactgggactagaagatcaccacaagatacggtggagaggactcctgatcattattttagcaaaaataataataataatggtaaaaaaccagggatgaaaaagaggaaggcttgtggtgtagatgagaaaggaagagagattaatttagatgctttaaaaggcagttatgctaatgatgttattgtgagtaccagtgacaatggaattgtgatcgaaatgaagtgcccctcgagagcaggaaggatgctagaaattatggaagcaattaacagtttcaatatagattttagttcagttcagtcaacagaagctgatggaaatctttatctgaccattaaatctgtgctcacaggaccaagggttgcaacagccaaaagaatcaaactagcactacaaaaagtggcttccaagtgc

SEQ ID NO: 1064 - protein, 626 aa, Glycine max
  Glyma05g37770.1  polypeptide
MVPENLKKQLALAVRSIHWSYAIFWTDSTTQPGVLSWGEGYYNGDIKTRKTSQGVELNSDQIGLQRSEQLRELFKSLKTVEVSPQTKRPSAALSPEDLTDAEWYYLVCMSFIFNIGQGLPGRTLAKGQSIWLNNAHSADCKIFSRSLLAKTVVCFPFREGVIELGTTEQVSEDLSVIERIKTSFLNSLHVDVPNKSVATLKSRKQEDLSYVAFDHNDYNVESIPEVGYEIANTTSPNGSSNAIQANQPLDDTLMVESITNGTSQVQNWQVIDDELSNCVHNSMNSSDCISPTFASLENIASAPKCNNPSDPCARDFQKCNNPKMTLVDPRSDEWHYQRVISTLIKNTDQLLMGMHLQKFPQASSFVSWRKGEPMDSQWPRAGTSQKLLKKVLFEVPQMHLDGLHESQEENDYKEGMRVEADENGMNHVMSERRRRAKLNQRFLTLRSMVPSISKDDKVSILDDAIEYLKKLERRINELEAHRGVTDIETGTRRSPQDTVERTPDHYFSKNNNNNGKKPGMKKRKACGVDEKGREINLDALKGSYANDVIVSTSDNGIVIEMKCPSRAGRMLEIMEAINSFNIDFSSVQSTEADGNLYLTIKSVLTGPRVATAKRIKLALQKVASKC

SEQ ID NO: 1065 - DNA, 1890 bp, Glycine max
  Glyma08g01810.1
atggtgccagagaacttgaagaaacaacttgctttggctgtgagaagcatccattggagctatgcaatcttctggactgattcaactacccaacccggggtgttgagctggggggaagggtattacaatggagacattaagactaggaaaacaagtcaaggagtagaactcaattctgaccaaatagggttgcagaggagtgaacagctgagagaactattcaaatccctcaaaactgtagaagtcacccctcaaaccaaaaggccttcagcagcagcactgtccccagaagatctcacagatgctgagtggtattacttggtttgcatgtccttcatattcaacattggccaagggttaccaggaagaactctagcaaagggtcaacccatttggctgaacaatgcccattcttctgattgtaaaatttttagccgttctcttctggcaaagagtgcatccattgagacggttgtgtgctttccgtttagggaaggggttattgagttaggtactactgaacaggtcccagaagatttgagtgtcattgaactgatcaaaacttctttcttgaatagtctgcatgccaatgttcccaataagtcagtagctacattgaaatcaaggaaccaggaagatctttcttatgcagcatttgatcataatgactataatgttaaatcaattccagaagttgggtatgaaatagccaacacaacctctcctgatggtagttcaaatgcattccaagccaatcaaccgctagatgaaacatttatgattgaaagtataaccaatggcacttctcaagtccaaaactggcaagttattgatgatgaattgagtaactgtgtccataactccatgaattccagcgactgtatatcacaaacttttgcctgccctgagaatattgcttctgcccccaagtctaacaacccttctgatccttgtgcccgaaattttcaaaagtgcaacaacccaaaaatgaccttagtggatcctcgaagtgatgatttgcactatcagagagttctttctacccttataaaaagttctgaccagttacttatgggaatgcatttgcaaaaatttcctcaggaatcaagctttgttagttggaggaaagaacagccaatggattgcaaatggccaagagcaggaacgtcacaaaagttattgaagaaagtattgtttgaagttcctcaaatgcacttggatgggctgcatgagtctcaagaagagaatgactataaagagggaatgagagtagaggctgatgaaaacggcatgaaccatgttatgtcagaaaggaggaggagagcaaaactaaatgaaaggtttttaacccttaggtcaatggtcccttcaatcagtaaggatgacaaagtttcaatactagatgatgctattgattaccttaaaaagctcgagagaagggtaaaagagttggaagctcacagggtggtaacagacatagagactgggactagaagatcaccacaagatacggtggagaggacttctgatcattattttaggaaaaataataatggcaagaaaccagggatgaaaaagaggaaggcttgtggtgtagatgagacagaaaaagagattaattcagatgctttaaaaggaagttatgctaatgatgttactgtgagtaccagtgacaatgaaattgtgatcgaattgaagtgcccctcgaaagcaggaaggctgctagaaattatggaagcaatcaacagtttcaatatagattttagttcagttcagtcaacagaagctgatggaaatctttatctgaccattaaatctgtgctcacaggaccaagtgttgcaacaaccaaaagaatcaaacaagcactccaaaaattggcttccaagtgc

SEQ ID NO: 1066 - protein, 630 aa, Glycine max
  Glyma08g01810.1  polypeptide
MVPENLKKQLALAVRSIHWSYAIFWTDSTTQPGVLSWGEGYYNGDIKTRKTSQGVELNSDQIGLQRSEQLRELFKSLKTVEVTPQTKRPSAAALSPEDLTDAEWYYLVCMSFIFNIGQGLPGRTLAKGQPIWLNNAHSSDCKIFSRSLLAKSASIETVVCFPFREGVIELGTTEQVPEDLSVIELIKTSFLNSLHANVPNKSVATLKSRNQEDLSYAAFDHNDYNVKSIPEVGYEIANTTSPDGSSNAFQANQPLDETFMIESITNGTSQVQNWQVIDDELSNCVHNSMNSSDCISQTFACPENIASAPKSNNPSDPCARNFQKCNNPKMTLVDPRSDDLHYQRVLSTLIKSSDQLLMGMHLQKFPQESSFVSWRKEQPMDCKWPRAGTSQKLLKKVLFEVPQMHLDGLHESQEENDYKEGMRVEADENGMNHVMSERRRRAKLNERFLTLRSMVPSISKDDKVSILDDAIDYLKKLERRVKELEAHRVVTDIETGTRRSPQDTVERTSDHYFRKNNNGKKPGMKKRKACGVDETEKEINSDALKGSYANDVTVSTSDNEIVIELKCPSKAGRLLEIMEAINSFNIDFSSVQSTEADGNLYLTIKSVLTGPSVATTKRIKQALQKLASKC

SEQ ID NO: 1067 - DNA, 1839 bp, Citrus clementina
  clementine0.9_005250m
atggatactactaagattcaaaatcagaagagagtgccagagagcctgaagaaacagctcgctcttgctgtgagaagcattcagtggagctatgcaattttctggaccatttcagatacacaacctggggtcttggagtggggtgatggctactacaatggagatattaagacaaggaaaacaattcaatcagtagagctcagttccaaccaattgggtttgcaaaggagtgagcaattgagagaattatacgaatctctttcggctggtgagagtcatccacaagctgccagcaaaagaccatcagcggcattgtcccctgaagatcttactgataccgagtggtattacttggtttgcatgtcatttaacttcaacatcggtgaagggttgccaggaagggcacttgcaaataatcagcctatatggttgtgcaatgctcagtatgcagacagcaaagtgttcagtcgttctctgctggcaaagacagtagtatgcttcccacatttgcatggtgtggttgagttgggggtaactgagctggtgttggaggaacctgattttattcagcacattaagacttcattcatggagattccatgtccaatgatttccggtaattccagtagcggtgctggaaacatgagagatgacaaagatctcgcttgtgctgcactttgttcacagaatcttgacactacaatggttccagttgtgggttatgaagtgttagaaatggcttctccagataacaacggttctagtggcatcaagcacaatcaaccagcagattattcatttatggttggaggcataaatggggtggcttctcaagtacaaagctggcaagtcatggatgatgagttcagtaactgtgttcattccgtgaattctagtgacagcatttcccaaacacttgtagatgctacgaaatgtgtctctgcttcaaaagatgataaaaaaattggccattgtttgcaagaagttgaagaatgtaatcccacagagctaacctcactggatccccaaggccatgatttgctctatcaaagtgtcctttcttcccttctaaaaacctcccatcagctagtttcgcggccgcattttcaaaaccacagccaagaatccagctttgccagttggaagaaaggtggattggtgagttgcaagaaacaaagagacggagtttcacaaaagttattgaagaagatcttatttgaagttcctcggataattaattacagattgcttgagtcgtcggaagataatcacattaaagatgatgtttcgagactagaggctgaggaaactgctactaaccatgtaaaatcggagaggaggcaaaggggaaagctaaatgaaagatttgttattctcaaatccatggtaccttcagtcagcaagtttgacaaagtatctatactagatgacacaatagaatacgtacaagagcttgagagaaaagtcaaagaattggagtcttgcagagcaaagttagaggctaattatgacaacagcaaaactagtagagcaaagaagagaaaatctcgtgacatctatgagtcggagccagagtttgaacgttttgcgacagcagataatataaatgtgagcataaatgaaaaggatgttcaaattgagatcaagtgtccatggagggaaggaatgttgctcgagattatggatgcaataagcaaccttcatttatattcccactcggttcagtcatccaccaatcgaggcattctatctcttactatcaaaagtgagtacagaggatcaaatgtcgcatcagctgggataatcaaacaatcactacaaagagttgcttggaagtgt

SEQ ID NO: 1068 - protein, 613 aa, Citrus clementina
  clementine0.9_005250m  polypeptide
MDTTKIQNQKRVPESLKKQLALAVRSIQWSYAIFWTISDTQPGVLEWGDGYYNGDIKTRKTIQSVELSSNQLGLQRSEQLRELYESLSAGESHPQAASKRPSAALSPEDLTDTEWYYLVCMSFNFNIGEGLPGRALANNQPIWLCNAQYADSKVFSRSLLAKTVVCFPHLHGVVELGVTELVLEEPDFIQHIKTSFMEIPCPMISGNSSSGAGNMRDDKDLACAALCSQNLDTTMVPVVGYEVLEMASPDNNGSSGIKHNQPADYSFMVGGINGVASQVQSWQVMDDEFSNCVHSVNSSDSISQTLVDATKCVSASKDDKKIGHCLQEVEECNPTELTSLDPQGHDLLYQSVLSSLLKTSHQLVSRPHFQNHSQESSFASWKKGGLVSCKKQRDGVSQKLLKKILFEVPRIINYRLLESSEDNHIKDDVSRLEAEETATNHVKSERRQRGKLNERFVILKSMVPSVSKFDKVSILDDTIEYVQELERKVKELESCRAKLEANYDNSKTSRAKKRKSRDIYESEPEFERFATADNINVSINEKDVQIEIKCPWREGMLLEIMDAISNLHLYSHSVQSSTNRGILSLTIKSEYRGSNVASAGIIKQSLQRVAWKC

SEQ ID NO: 1069 - DNA, 1887 bp, Populus trichocarpa
  POPTR_0001s09450.1
atggctactaagctccacaaccaagagagactaccagggaacctcaagaaacagcttgctattgctgtcaggagcattcagtggagctacgcaatcttctggtccatgtcagcaagacaaccaggagtgttggagtggggtgatgggtactacaacggagatattaaaacaaggaagacaattcaatccatagagcttgatgaagatgaattgggtttacagagaagtgagcagttaagagaactctacgagtcactttcagttggtgaagccagtccacaagctagaagaccttcagctgcattatctccagaagatctcactgatacagagtggtattatttggtttgcatgtccttcatattcgacattggccaaggcttgccaggaacaacattagcaaatggtcatcctacttggctatgcaatgctcattctgcagatagtaaagtattcagtcgctctctgctagctaagagtgcatcaattcagaccgtggtttgctttccatttatgagaggtgtgattgagctgggtgtgactgagcaggttttggaggacccaagtctcattaatcacataaaaacatcattcttggagatcccatacgcagtagctgccaagaattctagtgcaagaagtgaaaaagagcttgcatgtgccaccttcaatcgtgaaacacttgacaccaaaccgattccagttataggatgtggagaactagacataacttcccctaaccgcaattcaaatgatcagccggctgcagatttgattatggttgaagggctaaatggaggagcttcccaaatgcaaagtttgcagttcatggatgatgaccacagtgtccatcattccttgaattctagtgactgcatatctcaaaccattgtagatcctgtgaaggttgttcctattttgaagaatgtgaaggtaaataaccagaatcttctggatgttcaagactgcaatcacacgaagctgacttcgttggaccttcaaaaggaagattttcattatcaaagtgttctctcatgtctcttaaagacctccaatccattgattttaggacccgatgtccagaattgtcaccaggaatcgagctttgtcagttggaagaaagcaggatcggtgcatactcacaaattgaaaagtggaactcgacaaaaagtactaaagaagatactacttgaagttcctcggatgcatgttgatggcttgcttgactccccagaatataatagcaataaagttgtagtggggaggccagaggctgatgaaaatggtgcaagccatgcattatctgagaggaagcaaagagaaaagctgaataaaaggtttatgattctgaaatcaattgtcccttcaatcagcaaggtagttgataaagtatctatactagatgagaccatcgaataccttcaagagcttgaaagaaaggttgaagagttgggatctaacagggagctattggaggttcttaccaaaagaaaaccccaagatactgcggagaggacatctgataactatggcagcaataagattggaaatggaaaacattcgttgacaaataagaggaaggctccagacattgatgaaatggagccagatatcaaccataatgtatcaaaagatggttcagctgaaagtataactgtcagcgtgaataaagaggatgttctaatcgagatcaagtgtcgttggagggagggaatattgctggagataatggatgtagctagtcatctccatttagattctcactcggttcaatcatctaccatggacgggatcctttctctgactatcaaatcaaagcacaagggattgaatgctacatcaattggcacaatcaaacaagcccttcgaagagttgctgggaaatgt

SEQ ID NO: 1070 - protein, 629 aa, Populus trichocarpa
  POPTR_0001s09450.1  polypeptide
MATKLHNQERLPGNLKKQLAIAVRSIQWSYAIFWSMSARQPGVLEWGDGYYNGDIKTRKTIQSIELDEDELGLQRSEQLRELYESLSVGEASPQARRPSAALSPEDLTDTEWYYLVCMSFIFDIGQGLPGTTLANGHPTWLCNAHSADSKVFSRSLLAKSASIQTVVCFPFMRGVIELGVTEQVLEDPSLINHIKTSFLEIPYAVAAKNSSARSEKELACATFNRETLDTKPIPVIGCGELDITSPNRNSNDQPAADLIMVEGLNGGASQMQSLQFMDDDHSVHHSLNSSDCISQTIVDPVKVVPILKNVKVNNQNLLDVQDCNHTKLTSLDLQKEDFHYQSVLSCLLKTSNPLILGPDVQNCHQESSFVSWKKAGSVHTHKLKSGTRQKVLKKILLEVPRMHVDGLLDSPEYNSNKVVVGRPEADENGASHALSERKQREKLNKRFMILKSIVPSISKVVDKVSILDETIEYLQELERKVEELGSNRELLEVLTKRKPQDTAERTSDNYGSNKIGNGKHSLTNKRKAPDIDEMEPDINHNVSKDGSAESITVSVNKEDVLIEIKCRWREGILLEIMDVASHLHLDSHSVQSSTMDGILSLTIKSKHKGLNATSIGTIKQALRRVAGKC

SEQ ID NO: 1071 - DNA, 1887 bp, Populus trichocarpa
  POPTR_0003s12810.1
atggcaaatgagctccgtaaccaagagagactaccagacaacctcaagaaacagcttgctcttgctgtgaggagcattcaatggagctacgcaatcttctggtcaaatccaactggacaaccaggggttttggagtgggctgatgggtactacaatggagatattaagacacggaaaacagttcaatccatagagcttaatgcagatgaattgggtttacagagaagtgagcaattgagagaactctatgagtcactgtcggctggtgaagccaatccacaagcgaggagaccttcagctgcattatccccagaagatctcactgatacggagtggtattatttggtttgcatgtcctttgtattcgacaatggccagggcttgccaggaacaacattagcaaatggtcaccctacctggctatgcaacgctccttctgcagatagcaaaatattcagccgctctctgctagctaagactgttgtatgctttccatttatgagaggagttgttgagctgggtgtgtctgagcaggttttggaggacccaagtctcattcaacacatcaagacttcattcttggagatcccatacacagtaactgccaatcattctagtgcaaaaagtgacaaagagcttgcctgtgccactttcaatcgtgaaatacatgacaccaaacctgttccagttatacgatgtagagaactagacacactttcccctgatgacaattcaaatgatcaggcagccacagattctattatggttgaagggctaaatggaggagcttcccaagtgcaaagttggcagttcatggatgatgacttcagcaaccgtgttcatcatcccttgaattctagtgactctgtatctcaaaccattgtagatcctgtgatgcttgttccttttctgaaggatggaaaggtaaatggccagagtcttcaggacattcaagactgcaatcacaagaagctgactgcattgaaccttcaaagcgatgatttgcattatcaaagtgttctctcgtgtctcttaaagacctcccatccattaattcttggacccaatgtccagaattgttatcaggaaccgagctttgtcagttggaagaaagcaggattgatgcattctcaaaaattgaaaagtggaactccgcaaaaactactaaagaagatactgtttgaagttcctcggatgcatgttgatggtttgctggattccccggaatatagtagtgacaaagttgtaggtggcaggcccgaggctgatgaaattggcgcaagccatgtattatcagagaggaggcgaagagaaaagctgaataaaaggtttatgattctgaaatcaattgtcccttcaatcagcaaggttgataaagtatctatactagatgacacaattcaataccttcaagagcttgaaagaaaggttgaagagttggaatgtaggagggagcttttagaggcaataaccaaaagaaaacctgaagatactgtggagaggacatctgataactgcggcagcaataagattggaaatggtaaaaattcgttgacaaataagaggaaggctcctgacattgatgaaatggagccagataccaaccataacatatcaaaagatggttcagctgacgatataactgtcagcatgaataaaggggatgttgtaatcgagatcaagtgtctttggagggagggaatattgctcgagataatggatgcagcgagccatctccatttagattctcactcagttcaatcatccatcatggacgggattctttcgctgactatcaaatcaaagcacaagggattgaatgctgcatcagttggcacaatcaaacatgcccttcaaatggttgctgggaacttgttttcgaatcga

SEQ ID NO: 1072 - protein, 629 aa, Populus trichocarpa
  POPTR_0003s12810.1  polypeptide
MANELRNQERLPDNLKKQLALAVRSIQWSYAIFWSNPTGQPGVLEWADGYYNGDIKTRKTVQSIELNADELGLQRSEQLRELYESLSAGEANPQARRPSAALSPEDLTDTEWYYLVCMSFVFDNGQGLPGTTLANGHPTWLCNAPSADSKIFSRSLLAKTVVCFPFMRGVVELGVSEQVLEDPSLIQHIKTSFLEIPYTVTANHSSAKSDKELACATFNREIHDTKPVPVIRCRELDTLSPDDNSNDQAATDSIMVEGLNGGASQVQSWQFMDDDFSNRVHHPLNSSDSVSQTIVDPVMLVPFLKDGKVNGQSLQDIQDCNHKKLTALNLQSDDLHYQSVLSCLLKTSHPLILGPNVQNCYQEPSFVSWKKAGLMHSQKLKSGTPQKLLKKILFEVPRMHVDGLLDSPEYSSDKVVGGRPEADEIGASHVLSERRRREKLNKRFMILKSIVPSISKVDKVSILDDTIQYLQELERKVEELECRRELLEAITKRKPEDTVERTSDNCGSNKIGNGKNSLTNKRKAPDIDEMEPDTNHNISKDGSADDITVSMNKGDVVIEIKCLWREGILLEIMDAASHLHLDSHSVQSSIMDGILSLTIKSKHKGLNAASVGTIKHALQMVAGNLFSNR

SEQ ID NO: 1073 - protein, 195 aa, Arabidopsis thaliana
  AT4G00480.1 bHLH-MYC_N domain
LRKQLALAVRSVQWSYAIFWSSSLTQPGVLEWGEGCYNGDMKKRKKSYESHYKYGLQKSKELRKLYLSMLEGDSGTTVSTTHDNLNDDDDNCHSTSMMLSPDDLSDEEWYYLVSMSYVFSPSQCLPGRASATGETIWLCNAQYAENKLFSRSLLARSASIQTVVCFPYLGGVIELGVTELISEDHNLLRNIKSCL

SEQ ID NO: 1074 - protein, 56 aa, Arabidopsis thaliana
  AT4G00480.1 HLH domain
SQNSGLNQDDPSDRRKENEKFSVLRTMVPTVNEVDKESILNNTIKYLQELEARVEE

SEQ ID NO: 1075 - protein, 178 aa, Oryza sativa
  LOC_Os01g39560.1 bHLH-MYC_N domain
FRKQLAAAVRSISWTYAIFWSISTTRPGVLTWNDGFYNGEIKTRKIENNLVTELTAEQLLLQRSEQLRELYNSLLSGESADQQRRRPVTALSPEDLGNVEWYYVVCMTYAFRPGQCVPGKSFASNGCAWLCNAQSADSKAFPRKLLAKNASIQTIVCVPFMTGVLELGTTDPAAVARG

SEQ ID NO: 1076 - protein, 26 aa, Oryza sativa
  LOC_Os01g39560.1 HLH domain
YELINHVFPSLHDKNNANFASYMSTH

SEQ ID NO: 1077 - protein, 184 aa, Oryza sativa
  LOC_Os04g47040.1 bHLH-MYC_N domain
FRSLLAAAVRSISWSYAIFWSISTSCPGVLTWNDGFYNGVVKTRKISNSADLTAGQLVVQRSEQLRELYYSLLSGECDHRARRPIAALSPEDLADTEWYYVVCMTYSFQPGQGLPGKSYASNASVWLRNAQSADSKTFLRSLLAKSASIQTIICIPFTSGVLELGTTDPVLEDPKLVNRIVAYF

SEQ ID NO: 1078 - protein, 66 aa, Oryza sativa
  LOC_Os04g47040.1 HLH domain
RGSRAALTQESGIKNHVISERRRREKLNEMFLILKSIVPSIHKVDKASILEETIAYLKVLEKRVKE

SEQ ID NO: 1079 - protein, 185 aa, Oryza sativa
  LOC_Os04g47080.1 bHLH-MYC_N domain
FRSQLAAAARSINWTYAIFWSISTSRPGVLTWKDGFYNGEIKTRKITNSMNLMADELVLQRSEQLRELYDSLLSGECGHRARRPVAALLPEDLGDTEWYYVVCMTYAFGPRQGLPGKSFASNEFVWLTNAQSADRKLFHRALIAKSASIKTIVCVPFIMHGVLELGTTDPISEDPALVDRIAASF

SEQ ID NO: 1080 - protein, 68 aa, Oryza sativa
  LOC_Os04g47080.1 HLH domain
GDSSAAAMTTQGSSIKNHVMSERRRREKLNEMFLILKSVVPSIHRVDKASILAETIAYLKELEKRVEE

SEQ ID NO: 1081 - protein, 161 aa, Zea mays
  GRMZM2G172795_T01 bHLH-MYC_N domain
LRKQLAAAARSINWSYSLFWSISSTQRPRVLTWTDGFYNGEVKTRKISHSVELTADQLLMQRSEQLRELYEALQSGECDRRAARPVGSLSPEDLGDTEWYYVICMTYAFLPGQGLPGRSSASNEHVWLCNAHLAGSKDFPRALLAKVPEDPDLINRATAAF

SEQ ID NO: 1082 - protein, 69 aa, Zea mays
  GRMZM2G172795_T01 HLH domain
NCGGGGTTVTAQENGAKNHVMLERKRREKLNEMFLVLKSLVPSIHKVDKASILAETIAYLKELQRRVQE

SEQ ID NO: 1083 - protein, 160 aa, Zea mays
  GRMZM5G822829_T01 bHLH-MYC_N domain
LEKKLSRVLTWTDGFYNGEVKTRKISNSVELTSDHLVMQRSDQLRELYEALLSGEGDRRAAPARPAGSLSPEDLGDTEWYYVVSMTYAFRPGQGLPGRSFASDEHVWLCNAHLAGSKAFPRALLAKSILCIPVMGGVLELGTTDTVPEAPDLVSRATAAF

SEQ ID NO: 1084 - protein, 68 aa, Zea mays
  GRMZM5G822829_T01 HLH domain
GGATGAAQEMSGTGTKNHVMSERKRREKLNEMFLVLKSLLPSIHRVNKASILAETIAYLKELQRRVQE

SEQ ID NO: 1085 - protein, 181 aa, Zea mays
  GRMZM5G822829_T03 bHLH-MYC_N domain
MRSQLAAAARSINWSYALFWSISDTQPGVLTWTDGFYNGEVKTRKISNSVELTSDHLVMQRSDQLRELYEALLSGEGDRRAAPARPAGSLSPEDLGDTEWYYVVSMTYAFRPGQGLPGRSFASDEHVWLCNAHLAGSKAFPRALLAKSILCIPVMGGVLELGTTDTVPEAPDLVSRATAAF

SEQ ID NO: 1086 - protein, 68 aa, Zea mays; identical to SEQ ID NO: 1084
  GRMZM5G822829_T03 HLH domain

SEQ ID NO: 1087 - protein, 179 aa, Setaria italica
  Si000845m bHLH-MYC_N domain
LRNHLAAAVRSINWTYALFWSISSTQPGFLTWTDGFYNGEVKTRKIVNSAELTADQLVMQRSEQLRELYEALLSGECDRRAARPVASLSPEDLGDTELYYVVCMTYAFRPGQGLPGRSFASNERVWMWNSHLADSKAFPRALLAKTIVCIPLMSGVLELGTTDAVVEDPSLVSRATASF

SEQ ID NO: 1088 - protein, 67 aa, Setaria italica
  Si000845m HLH domain
GGGGTTRMAQESGVKNHVMSERKRREKLNEMFLVLKSLVPSIHKVDKASILAETIAYLKELQRRVQE

SEQ ID NO: 1089 - protein, 138 aa, Setaria italica
  Si012401m bHLH-MYC_N domain
FLTWTDGFYNGEVKTRKIANSAELTADQLVMQRSEQLRELYEALLSGECDRRTARPVASLSPEDLGDTEWYYVVCMTYAFRPGQGLPGRSFASNERVWMRNSHLADSKAFPRALLAKTIVCIPFMSGVLELGTTDAEP

SEQ ID NO: 1090 - protein, 67 aa, Setaria italica; identical to SEQ ID NO: 1088
  Si012401m HLH domain

SEQ ID NO: 1091 - protein, 190 aa, Arabidopsis thaliana
  AT1G63650.1 bHLH-MYC_N domain
LKKQLAVSVRNIQWSYGIFWSVSASQPGVLEWGDGYYNGDIKTRKTIQAAEVKIDQLGLERSEQLRELYESLSLAESSASGSSQVTRRASAAALSPEDLTDTEWYYLVCMSFVFNIGEGIPGGALSNGEPIWLCNAETADSKVFTRSLLAKSASLQTVVCFPFLGGVLEIGTTEHIKEDMNVIQSVKTLF

SEQ ID NO: 1092 - protein, 64 aa, Arabidopsis thaliana
  AT1G63650.1 HLH domain
EELLPDTPEETGNHALSEKKRREKLNERFMTLRSIIPSISKIDKVSILDDTIEYLQDLQKRVQE

SEQ ID NO: 1093 - protein, 193 aa, Arabidopsis thaliana
  AT5G41315.1 bHLH-MYC_N domain
LKKHLAVSVRNIQWSYGIFWSVSASQSGVLEWGDGYYNGDIKTRKTIQASEIKADQLGLRRSEQLSELYESLSVAESSSSGVAAGSQVTRRASAAALSPEDLADTEWYYLVCMSFVFNIGEGMPGRTFANGEPIWLCNAHTADSKVFSRSLLAKSAAVKTVVCFPFLGGVVEIGTTEHITEDMNVIQCVKTSF

SEQ ID NO: 1094 - protein, 67 aa, Arabidopsis thaliana
  AT5G41315.1 HLH domain
EKLMLDSPEARDETGNHAVLEKKRREKLNERFMTLRKIIPSINKIDKVSILDDTIEYLQELERRVQE

SEQ ID NO: 1095 - protein, 184 aa, Citrus clementina
  clementine0.9_004500m bHLH-MYC_N domain
LRKQLAVAVRSIQWSYAIFWSLSAAQQGVLEWGDGYYNGDIKTRKTMQAMELTPDKIGLQRSKQLRELYESLLKGESELAYKRPSAALSPEDLTDAEWYYLVCMSFVFSSGQGLPGRALANSETIWLCNAQCADSKVFSRSLLAKSASIQTVICFPHLDGVIELGVTELVPEDPSLLQHIKASL

SEQ ID NO: 1096 - protein, 70 aa, Citrus clementina
  clementine0.9_004500m HLH domain
SQKEICRKYCPVTMESDNFCEEHISSDKRTENEKFMVLRSMVPYISEVDKASILSDTIKYLKKLEARVEE

SEQ ID NO: 1097 - protein, 139 aa, Citrus clementina
  clementine0.9_005551m bHLH-MYC_N domain
MQFSGHYQLHNKGLQRSKQLRELYESLLKGESELAYKRPSAALSPEDLTDAEWYYLVCMSFVFSSGQGLPGRALANSETIWLCNAQCADSKVFSRSLLAKSASIQTVICFPHLDGVIELGVTELVPEDPSLLQHIKASL

SEQ ID NO: 1098 - protein, 70 aa, Citrus clementina; identical to SEQ ID NO: 1096
  clementine0.9_005551m HLH domain

SEQ ID NO: 1099 - protein, 138 aa, Citrus clementina
  clementine0.9_005579m bHLH-MYC_N domain
MQAMELTPDKIGLQRSKQLRELYESLLKGESELAYKRPSAALSPEDLTDAEWYYLVCMSFVFSSGQGLPGRALANSETIWLCNAQCADSKVFSRSLLAKSASIQTVICFPHLDGVIELGVTELVPEDPSLLQHIKASL

SEQ ID NO: 1100 - protein, 70 aa, Citrus clementina; identical to SEQ ID NO: 1096
  clementine0.9_005579m HLH domain

SEQ ID NO: 1101 - protein, 184 aa, Eucalyptus grandis
  Eucgr.D02287.1 bHLH-MYC_N domain
LRKQLAVAVRSIQWSYAIFWTLSATKQGVLQWGDGYYNGDIKTRKTVQAVELKPDKIGLQRSEQLRDLYESLLEGETDAQNKRPSAALSPEDLTDEEWYYLVCMSFVFNPGEGLPGRALADGQTIWLCNAQYADSKVFSRSLLAKSASIQTVVCFPYLGGVIELGVTELVPEDPSLLQHIKVSL

SEQ ID NO: 1102 - protein, 67 aa, Eucalyptus grandis
  Eucgr.D02287.1 HLH domain
SELQNGVESLLGDVDFCAGHILSTKKKEHEKFLVLRSMIPSIEEIDKASILDDTIMYLRELEARVEE

SEQ ID NO: 1103 - protein, 187 aa, Glycine max
  Glyma03g01180.1 bHLH-MYC_N domain
LCTQLAVAVRSIQWSYGIFWSPSTTEERVLEWREGYYNGDIKTRKTVQATELEIKADKIGLQRSEQLKELYKFLLAGEADHPQTKRPSVALAPEDLSDLEWYYLVCMSFVFNHNQSLPGRALEIGDTVWLCNAQHADSKVFSRSLLAKSATIQTVVCFPYQKGVIEIGTTELVAEDPSLIQHVKACF

SEQ ID NO: 1104 - protein, 72 aa, Glycine max
  Glyma03g01180.1 HLH domain
SQKGNDRMEWTSKLENDDHGLIGKAFSDKKREIKNFQVVKSMVPSSISEVEKISILGDTIKYLKKLETRVEE

SEQ ID NO: 1105 - protein, 181 aa, Glycine max
  Glyma07g07740.1 bHLH-MYC_N domain
LCTQLAVAVRSTQWSYGIFWAPSTTEERVLEWREGYYNGDIKTRKTVQAMELEMKADKIGLQRSEQLKELYKFLLAGEADPQTKRPSAALAPEDLSDLEWYYLVCMSFVFNHNQSLPGRALEIGDTVWLCNAQHADSKIFSRSLLAKTVVCFPYQKGVIEIGTTELVTEDPSLIQHVKACF

SEQ ID NO: 1106 - protein, 72 aa, Glycine max
  Glyma07g07740.1 HLH domain
SQKENGRMKWTSKLENANDGFMEKTFSDKKRENKNFHVVKPMVPSSISEVEKISILGDTIKYLKKLETRVEE

SEQ ID NO: 1107 - protein, 183 aa, Populus trichocarpa
  POPTR_0002s16080.1 bHLH-MYC_N domain
LRKQLAIAVRSVQWSYAIFWSLSTRQKGVLEWGGGYYNGDIKTRKVQATELKADKIGLQRSEQLRELYKSLLGGDAGQQAKRSSPALSPEDLSDEEWYYLVCMSFVFNPGEGLPGRALANKQTIWLCNAQYADSKVFSRSLLAKSASIQTVVCFPYLEGVMELGVTELVTEDPSLIQHIKASL

SEQ ID NO: 1108 - protein, 70 aa, Populus trichocarpa
  POPTR_0002s16080.1 HLH domain
FDKENGGTDCLKKLEGCETCKEHYKSDKQRVNDKFIVLRSMVPSISEIDKESILSDTINYLKQLESRVAE

SEQ ID NO: 1109 - protein, 183 aa, Populus trichocarpa
  POPTR_0014s07960.1 bHLH-MYC_N domain
LRKQLAVAVRSVQWSYAVFWSQSTRQQGVLEWGDGYYNGDIKTRKVEAMELKADKIGLQRSEQLRELYESLLEGETGLQATRSSPALSPEDLSDEEWYYLVCMSFVFNPGEGLPGRALANKQPIWLCNAQYADSKVFSRSLLAKSASIQTVVCFPYLEGVIELGVTELVTEDPGLIQHIKASL

SEQ ID NO: 1110 - protein, 70 aa, Populus trichocarpa
  POPTR_0014s07960.1 HLH domain
SDKENAGKDCLKNLEGCETCKLHFESEKQKENEKYLALESIVASINEIDKASILSDTINYPRQLESRVAE

SEQ ID NO: 1111 - protein, 184 aa, Vitis vinifera
  GSVIVT01026927001 bHLH-MYC_N domain
LSKQLAVAVRSIQWSYAIFWSLSTRQQGVLEWSGGYYNGDIKTRKTVQEMELKADKMGLQRSEQLRELYESLLEGETDQQSKRPSAALSPEDLSDAEWYYLVCMSFVFNPGEGLPGRALANGQSIWLCDAQYADSKVFSRSLLAKSASIQTVVCFPHMGGVIELGVTELVPEDPSLIQHIKACL

SEQ ID NO: 1112 - protein, 70 aa, Vitis vinifera
  GSVIVT01026927001 HLH domain
SQKENAGRDGLWKSGSDGICKQHALSDKKREKEKFLVLRSMVPSINKIDEVSILGDTIEYLKKLEARVEE

SEQ ID NO: 1113 - protein, 188 aa, Solanum lycopersicum
  Solyc08g081140.2.1 bHLH-MYC_N domain
LRKQLALAVRGIQWSYAIFWSTAVTQPGVLKWIDGYYNGDIKTRKTVQAGEVNEDQLGLHRTEQLKELYSSLLTSESEEDLQPQAKRPSASLSPEDLTDTEWYFLVCMSFVFNVGQGLPGKTLATNETVWLCNAHQAESKVFSRSLLAKSASIQTVVCFPYLGGVIELGVTELVTEDPNLIQQIKNSF

SEQ ID NO: 1114 - protein, 73 aa, Solanum lycopersicum
  Solyc08g081140.2.1 HLH domain
FSRENGKKNSLWRPEVDDIDRNRVISERRRREKINERFMHLASMLPTSSKVDKISLLDETIEYMKELERRVQE

SEQ ID NO: 1115 - protein, 184 aa, Vitis vinifera
  GSVIVT01019750001 bHLH-MYC_N domain
LRNQLALAVRNIQWSYAIFWSISTRQPGVLEWGDGYYNGDIKTRKTVQAVEFNADQMGLQRSEQLRELYESLSIGESNPQPRRHSAALSPEDLTDAEWYYLVCMSFVFDIGQGLPGRTLASGQPIWLCNAPYAESKVFSRSLLAKSASIQTVVCFPYLGGVIELGATEMVLEDPSLIQHIKTSF

SEQ ID NO: 1116 - protein, 73 aa, Vitis vinifera
  GSVIVT01019750001 HLH domain
SRDNNGDNDEIWRPEADEITLNHVLSERKRREKINERFSVLRSLVPSINQVNKVSVLDDTIEYLKELKRRVEE

SEQ ID NO: 1117 - protein, 184 aa, Eucalyptus grandis
  Eucgr.D01841.1 bHLH-MYC_N domain
LKKQLALAVRKIQWSYGIFWSISTRQPGVLEWGDGYYNGDIKTRKTIQAVELNTDQIGMQRSEQLRELYESLSAGESSPQVRRPSAALSPEDLTDAEWYYLVCMSFIYDIGQGLPGRTLTTGQPTWLCNAHYADSKVFTRSLLAKSASIQTVVCFPFRGGVIELGVTDQVSEDPGVIHQVKGTL

SEQ ID NO: 1118 - protein, 73 aa, Eucalyptus grandis
  Eucgr.D01841.1 HLH domain
SPLEDGGENGVWRPEADEIGLNHAILERKQKEKINDRLGVLKSMVPSVSKVDKLSILDDTIAYLRELQRKVEE

SEQ ID NO: 1119 - protein, 141 aa, Eucalyptus grandis
  Eucgr.E00624.1 bHLH-MYC_N domain
MTQAIELNGGDHMDLHRSEQLRELYESLSGSEPNPQTSRRPSVALSPEDLADAEWYYLVCMSFIFNIGQCLPGQSLATGKLIWLCNAHCADSKVFSRSLLAKSASIQTVVCFPFLDGVIELGTTDPVLEDPNLIQHVKTYL

SEQ ID NO: 1120 - protein, 73 aa, Eucalyptus grandis
  Eucgr.E00624.1 HLH domain
ISKVSCKRDGLWMALTDELSPDHTLSESRQREKINEQFSVLNSILPLVNKVDKISILDNTIEYVKELQRRAEE

SEQ ID NO: 1121 - protein, 179 aa, Glycine max
  Glyma05g37770.1 bHLH-MYC_N domain
LKKQLALAVRSIHWSYAIFWTDSTTQPGVLSWGEGYYNGDIKTRKTSQGVELNSDQIGLQRSEQLRELFKSLKTVEVSPQTKRPSAALSPEDLTDAEWYYLVCMSFIFNIGQGLPGRTLAKGQSIWLNNAHSADCKIFSRSLLAKTVVCFPFREGVIELGTTEQVSEDLSVIERIKTSF

SEQ ID NO: 1122 - protein, 72 aa, Glycine max
  Glyma05g37770.1 HLH domain
SQEENDYKEGMRVEADENGMNHVMSERRRRAKLNQRFLTLRSMVPSISKDDKVSILDDAIEYLKKLERRINE

SEQ ID NO: 1123 - protein, 185 aa, Glycine max
  Glyma08g01810.1 bHLH-MYC_N domain
LKKQLALAVRSIHWSYAIFWTDSTTQPGVLSWGEGYYNGDIKTRKTSQGVELNSDQIGLQRSEQLRELFKSLKTVEVTPQTKRPSAAALSPEDLTDAEWYYLVCMSFIFNIGQGLPGRTLAKGQPIWLNNAHSSDCKIFSRSLLAKSASIETVVCFPFREGVIELGTTEQVPEDLSVIELIKTSF

SEQ ID NO: 1124 - protein, 72 aa, Glycine max
  Glyma08g01810.1 HLH domain
SQEENDYKEGMRVEADENGMNHVMSERRRRAKLNERFLTLRSMVPSISKDDKVSILDDAIDYLKKLERRVKE

SEQ ID NO: 1125 - protein, 181 aa, Citrus clementina
  clementine0.9_005250m bHLH-MYC_N domain
LKKQLALAVRSIQWSYAIFWTISDTQPGVLEWGDGYYNGDIKTRKTIQSVELSSNQLGLQRSEQLRELYESLSAGESHPQAASKRPSAALSPEDLTDTEWYYLVCMSFNFNIGEGLPGRALANNQPIWLCNAQYADSKVFSRSLLAKTVVCFPHLHGVVELGVTELVLEEPDFIQHIKTSF

SEQ ID NO: 1126 - protein, 73 aa, Citrus clementina
  clementine0.9_005250m HLH domain
SSEDNHIKDDVSRLEAEETATNHVKSERRQRGKLNERFVILKSMVPSVSKFDKVSILDDTIEYVQELERKVKE

SEQ ID NO: 1127 - protein, 184 aa, Populus trichocarpa
  POPTR_0001s09450.1 bHLH-MYC_N domain
LKKQLAIAVRSIQWSYAIFWSMSARQPGVLEWGDGYYNGDIKTRKTIQSIELDEDELGLQRSEQLRELYESLSVGEASPQARRPSAALSPEDLTDTEWYYLVCMSFIFDIGQGLPGTTLANGHPTWLCNAHSADSKVFSRSLLAKSASIQTVVCFPFMRGVIELGVTEQVLEDPSLINHIKTSF

SEQ ID NO: 1128 - protein, 74 aa, Populus trichocarpa
  POPTR_0001s09450.1 HLH domain
SPEYNSNKVVVGRPEADENGASHALSERKQREKLNKRFMILKSIVPSISKVVDKVSILDETIEYLQELERKVEE

SEQ ID NO: 1129 - protein, 179 aa, Populus trichocarpa
  POPTR_0003s12810.1 bHLH-MYC_N domain
LKKQLALAVRSIQWSYAIFWSNPTGQPGVLEWADGYYNGDIKTRKTVQSIELNADELGLQRSEQLRELYESLSAGEANPQARRPSAALSPEDLTDTEWYYLVCMSFVFDNGQGLPGTTLANGHPTWLCNAPSADSKIFSRSLLAKTVVCFPFMRGVVELGVSEQVLEDPSLIQHIKTSF

SEQ ID NO: 1130 - protein, 73 aa, Populus trichocarpa
  POPTR_0003s12810.1 HLH domain
SPEYSSDKVVGGRPEADEIGASHVLSERRRREKLNKRFMILKSIVPSISKVDKVSILDDTIQYLQELERKVEE

SEQ ID NO: 1131 - DNA, 1554 bp, Arabidopsis thaliana
  AT4G09820.1
atggatgaatcaagtattattccggcagagaaagtggccggagctgagaaaaaagagcttcaagggctgcttaagacggcggttcaatctgtggactggacttatagtgtcttctggcaattttgtcctcaacaacgggtcttggtgtgggggaatggatactacaacggtgcaataaagacgaggaagacaactcaaccagcggaggtgacggcagaagaggcggcgttagagaggagccaacagctcagggagctttatgagacacttttagccggagagtcaacgtcagaagcaagagcatgcaccgcattgtcaccggaggatttgacggagacagaatggttttatctaatgtgcgtctctttctcttttcctcctccatctgggatgccaggaaaagcgtatgcaaggaggaagcacgtatggctaagtggtgcaaatgaagttgacagtaaaactttttctagagctattctcgctaagagtgctaaaattcagacagtggtttgcattccaatgcttgatggtgttgtggaactaggcacaacgaaaaaggtaagagaagatgtagagtttgttgagctcacaaagagtttcttctatgaccactgcaagacgaacccaaagccggctctttctgaacactccacctacgaagtgcatgaagaagccgaagacgaagaagaagtagaagaagagatgacaatgtcagaggaaatgaggcttggctctcctgatgatgaagatgtttccaatcaaaatctacactctgatcttcatattgaatcaacccatacgttagacacacatatggacatgatgaatctaatggaggaaggtggaaactattctcagacagtaacaacacttctcatgtcacaccccacaagtcttctttcagattcagtttccacatcttcttacatccaatcatcgtttgccacgtggagggttgagaatggcaaagagcatcagcaagtgaaaacggcgccgtcgtcacaatgggtgctcaaacaaatgatcttcagagttcctttcctccatgacaacactaaagataagaggctaccgcgggaagatctgagccacgtagtagcagagcgacgcaggagggagaagctgaacgagaaattcataacgttgagatcaatggttccatttgtgaccaagatggataaagtctcaatccttggagacaccattgcgtacgtaaatcatcttcgaaagagggtccatgagcttgagaatactcatcatgagcaacagcataagcggacgcgtacttgtaagagaaaaacatcggaggaggtggaggtttccatcatagagaatgatgttttgttagagatgagatgtgagtaccgagatggtttgttgcttgacattcttcaggttcttcatgagcttggtatagagactacggcagttcatacctcggtgaacgaccatgatttcgaggcggagataagggcgaaagtaagagggaagaaagcaagcatcgctgaggtcaaaagagccatccaccaagtcataatacatgatactaatcta

SEQ ID NO: 1132 - protein, 518 aa, Arabidopsis thaliana
  AT4G09820.1  polypeptide
MDESSIIPAEKVAGAEKKELQGLLKTAVQSVDWTYSVFWQFCPQQRVLVWGNGYYNGAIKTRKTTQPAEVTAEEAALERSQQLRELYETLLAGESTSEARACTALSPEDLTETEWFYLMCVSFSFPPPSGMPGKAYARRKHVWLSGANEVDSKTFSRAILAKSAKIQTVVCIPMLDGVVELGTTKKVREDVEFVELTKSFFYDHCKTNPKPALSEHSTYEVHEEAEDEEEVEEEMTMSEEMRLGSPDDEDVSNQNLHSDLHIESTHTLDTHMDMMNLMEEGGNYSQTVTTLLMSHPTSLLSDSVSTSSYIQSSFATWRVENGKEHQQVKTAPSSQWVLKQMIFRVPFLHDNTKDKRLPREDLSHVVAERRRREKLNEKFITLRSMVPFVTKMDKVSILGDTIAYVNHLRKRVHELENTHHEQQHKRTRTCKRKTSEEVEVSIIENDVLLEMRCEYRDGLLLDILQVLHELGIETTAVHTSVNDHDFEAEIRAKVRGKKASIAEVKRAIHQVIIHDTNL

SEQ ID NO: 1133 - DNA, 1632 bp, Glycine max
  Glyma03g30940.1
atggctacaccaccgccaaataacagccttcagaccatgttgcgggctgcagtgcaatctgttcagtggacttacagcctcttctggcaactttgtcctcataaagggattctaacatggggtgatggatactacaatggagcaattaagacacgaaagacagttcaagcaatggaagttagcaccgaagaagcgtctctgcaaagaagcgagcaacttagggagttatatgaatcgttgtctggtggggagacaaacgcaaaaacacgaagaccatgtgcttctttgtcgccggaggatctaacggaaaccgaatggttctatttgttgtgtgtctctttctcctttcatcctggtctcgggttgcccggaacagcatatgctagaaggcagcatttatggctcagtggagcgaacgaagtagacagcaaaacattttcaagagctattcttgccaagacagtggtgtgcattccagtgttggagggcgtcgttgagttgggcacaaccgataagatggaggaagacctaaatttcatccaacacataaagagcttcttcatagatcagcagcatcctgctctcacggcaaagcctgcactatcagaacagtactccacttccaagcccacttcttcttcttcttcataccctcttgtcactgccaataatactattccaatccaaaacattgttgatagaggagaagctataatattgaataataataccaaagaagcagaattagcagtccctaacagtagtttcataccgagcgagctaatggaactggatgccaccttggaggaattcagggttggatcatctggagatggctccaaccacttggattcattccccactgagaaatctatggcactgtgttcagcagggttggagctccttcaacttcaacttccaccagctccagagaagactcctattaaaatacttaaaaatatcatccttcaaaagaactccaggaggtggccggaatcaccctctctcaacctcctcactgactccttccaatcagctttcaacaaatggaactccggcgctgacgactaccagcaccatttccacgtgtcggtggccagcgtcacctcccagtggctcctcaagtacattttgttcagcgtcccttacttgcacaccaactggctcaagggcaagggcacttcaccatacgagaccagtcacgtgatggcggagcgtcaccgaagggagaagttgaatgagaggtttctcattctgcgttcgatggtgccttccgtgacaagaatggacaaggcgtctatcctgggagacaccatcgaatacatcaaacagttgagagataagattgagagccttgaggcgcgtaagcgcctcacgggaaagagaaggatgaggcaggtggaggtttcaatcatagagagcgaggcgctgttggaggtggagtgcgtgcatagggaagggttgttgttggatctgatgacaaagttgagggagttaggggtggaagtgatgatggtgcagtcttgggttaaggatgatggagtgtttgtggcggagatgagagccatggtgagggaaaatggtaacgggataaaggctatgatcatttttagccatgcttttggactaagg

SEQ ID NO: 1134 - protein, 544 aa, Glycine max
  Glyma03g30940.1   polypeptide
MATPPPNNSLQTMLRAAVQSVQWTYSLFWQLCPHKGILTWGDGYYNGAIKTRKTVQAMEVSTEEASLQRSEQLRELYESLSGGETNAKTRRPCASLSPEDLTETEWFYLLCVSFSFHPGLGLPGTAYARRQHLWLSGANEVDSKTFSRAILAKTVVCIPVLEGVVELGTTDKMEEDLNFIQHIKSFFIDQQHPALTAKPALSEQYSTSKPTSSSSSYPLVTANNTIPIQNIVDRGEAIILNNNTKEAELAVPNSSFIPSELMELDATLEEFRVGSSGDGSNHLDSFPTEKSMALCSAGLELLQLQLPPAPEKTPIKILKNIILQKNSRRWPESPSLNLLTDSFQSAFNKWNSGADDYQHHFHVSVASVTSQWLLKYILFSVPYLHTNWLKGKGTSPYETSHVMAERHRREKLNERFLILRSMVPSVTRMDKASILGDTIEYIKQLRDKIESLEARKRLTGKRRMRQVEVSIIESEALLEVECVHREGLLLDLMTKLRELGVEVMMVQSWVKDDGVFVAEMRAMVRENGNGIKAMIIFSHAFGLR

SEQ ID NO: 1135 - DNA, 1794 bp, Glycine max
  Glyma19g33770.1
atggctacgccgccaaatagcaggcttcacaccatgttgcgggcatcagtgcaatcagttcagtggacttacagcctcttctggcaactttgtccacaacaagggatattgacttggggtgatggatactacaacggagcaattaagacacggaagacagtgcaagcaatggaggtaagcactgaggaagcgtctctgcaaagaagcgagcaactaagggagttatatgaatctttgtctgctgaggagacaataaacacgcaaacacgaaggccatgtgctgctttgtcgcctgaggatctaactgaatccgaatggttctatttgttgtgtgtctctttctcctttcatcttggtatcgggttgcccggaacagcatatgccaggaggcagcatttatggctcagtggtgcaaacgaagtagacagcaaaactttttcaagagctattcttgccaagacagtggtgtgtattcctgtgttggagggcgtcgttgagttgggcacaaccgataagatcgaagaagacctaaatttcatccaacacataaagagcttcttcatagatcagcagcctcctcctcccacggcaaagcctgcactgtcagagcactccacctccaatctcacttcttcataccctcttgttattgttcctgtcactgctgccgccaccgccaataatgttctcatccaaaacgacatgaacattgttgataaaggagaagctattatattgaataataataataataataccgaagcagaattattagcagaccctaacagtaacagtttcataccgagcgagctaatggagctggaccaccagttggaggaattcggggtcggatcacctggagatggctccaatcacttggattccttccccaaagaggagtcaatggcactgtgtgctgcagggttggagctccttcaacttcaacgaccaccagctccagttgatacatatgataaaatgatatgttttatattttgttttgcagcacatcctcccacagaaaatctagcacaaggcgacacagacacccactactctcaaacagtgtccagcatccttaaaaagaactccagcaggtggtggccggattcaccctccgtcaaccaccccactgactccttccaatcagctttcaacaaatggaaatccgacactgacaaccaccaccactatttccacgagacggtggccgatggcacctcgcaggggctcctcaagtacattttgttcaacgtcccttacttgcacgccaaccggctcaagggcacgggagcttcgtcatacgagactaatcacgtgatggcggagcgccgcagaagggagaagttgaatgagaggtttctcattctacgttcgatggtacctttcatgatgaggatggacaaggagtccattctggaagataccatccactacatcaaacagttaagagagaagattgagagtctcgaagcgcgtgagcgcctccgggggaagaggagagtgagggaggtggaggtttcgatcatagagagcgaggcgctgttggaggtggagtgtgtgcatagggaaaggttgttgctggatgtgatgacaatgttgagggagttaggggtggaagtgatgatggtgcagtcttgggttaaggatgatggagtgtttgtggcggagatgagggccaaggtgaaggaaaatggtaacgggaaaaaggctagtgttgttgaagtgaaaaatgcccttaaccagattataccacatcatgagccatacacactttgttccaatgatcacttt

SEQ ID NO: 1136 - protein, 598 aa, Glycine max
  Glyma19g33770.1   polypeptide
MATPPNSRLHTMLRASVQSVQWTYSLFWQLCPQQGILTWGDGYYNGAIKTRKTVQAMEVSTEEASLQRSEQLRELYESLSAEETINTQTRRPCAALSPEDLTESEWFYLLCVSFSFHLGIGLPGTAYARRQHLWLSGANEVDSKTFSRAILAKTVVCIPVLEGVVELGTTDKIEEDLNFIQHIKSFFIDQQPPPPTAKPALSEHSTSNLTSSYPLVIVPVTAAATANNVLIQNDMNIVDKGEAIILNNNNNNTEAELLADPNSNSFIPSELMELDHQLEEFGVGSPGDGSNHLDSFPKEESMALCAAGLELLQLQRPPAPVDTYDKMICFIFCFAAHPPTENLAQGDTDTHYSQTVSSILKKNSSRWWPDSPSVNHPTDSFQSAFNKWKSDTDNHHHYFHETVADGTSQGLLKYILFNVPYLHANRLKGTGASSYETNHVMAERRRREKLNERFLILRSMVPFMMRMDKESILEDTIHYIKQLREKIESLEARERLRGKRRVREVEVSIIESEALLEVECVHRERLLLDVMTMLRELGVEVMMVQSWVKDDGVFVAEMRAKVKENGNGKKASVVEVKNALNQIIPHHEPYTLCSNDHF

SEQ ID NO: 1137 - DNA, 1743 bp, Glycine max
  Glyma10g03140.1
atggctgcgccactaggcactagccttcaaagcatgttgcaggctgcggtgcaatctgttcagtggacttatagtctcttctggcaactttgtccacaacaagggattctggtttggggtgatggttactacaatggagcaattaaaacacggaagacggtgcaaccaatggaggtgagtgctgaagaggcttctctccaaagaagccagcaacttagagaactctatgaatcactgtccgccggagagacaaacccgccttgtcgccggccttgtgccgccttgtcgcctgaggacttaacagaatccgaatggttctatttgatgtgtgtctcattctcctttccacctggtgttgggttgcctggaaaggcatatgcgaggaggcagcatctatggctcacgggtgcaaatgaggtggacagcaaaacattttcacgagctattctagccaagctgcagactgtggtgtgcattcctttattggacggtgtggttgagtttggcacaatggataagcaacgtgaacctaacctaaccaccatgtctttcttctctttcttgaacactcaacctcaaaccccgcctcctcctctgaacacatccccgccgtcatacaaagccggatacggcatcgctcgccaaactccgacaccagccatggcggcagagcccagcgagctgatacaactagagatgccggaggacatccggcttgggtctccaaacgatgggtcaaacaacttagactcagattttcacttgctggcggtgagtcagggtgttaacacagcggggcaggctgagtcaactcggaggtggggcctgagtcaaaaccccatgcaagttcaactaccgacttcagcccttcatccattggaagacttgacacaagaggacactcactactctcaaacagtgtccaacatcctccaaaaccagttcacacggtggccagcctcaccctcctccgttggatacgtctcatactccacgcaatcagcattcgcaaaatggagcagccgcgccagccaccaccacttccacccggcggcggcggcggcggcggacggcaccagccagtgcatcctcaagtacatcctcttcacggtcccgtacctccacgccaagaaccccggcgagaggagcgccgcaggaggagctcagcgccaaccacgtgctggccgagcgccgccgccgcgagaagctgaacgagaggttcataatcctgcggtcgctggtccccttcgtgaccaaaatggacaaggcgtcgatattgggagacaccatcgagtacgtgaagcagttgcggcggaagatccaggagctcgaggcgcattatacatatatatagcagttcagagaacaagtagcagttcgagcaaggagcaacagaggagtggggtgacaatgacggagaagaggaaggtgaggatcgtggaaggggtggtggcgaaggcgaaggcggtggaggctgaggccaccacgtcggtgcaagtttcgatcatagaaagcgacgcactgttggagatcgagtgtcgtcacaaagaagggttgcttctggacgtgatgcagatgctgagggaggtgaggatagaagttataggggtgcagtcgtcgcttaacaatggggtgttcgtggcggagttgagggctaaggtgaaggaacatgcaaacggcaagaaggtcagcattgtggaagtgaagagggcacttaaccaaattataccccatgctgttgac

SEQ ID NO: 1138 - protein, 581 aa, Glycine max
  Glyma10g03140.1   polypeptide
MAAPLGTSLQSMLQAAVQSVQWTYSLFWQLCPQQGILVWGDGYYNGAIKTRKTVQPMEVSAEEASLQRSQQLRELYESLSAGETNPPCRRPCAALSPEDLTESEWFYLMCVSFSFPPGVGLPGKAYARRQHLWLTGANEVDSKTFSRAILAKLQTVVCIPLLDGVVEFGTMDKQREPNLTTMSFFSFLNTQPQTPPPPLNTSPPSYKAGYGIARQTPTPAMAAEPSELIQLEMPEDIRLGSPNDGSNNLDSDFHLLAVSQGVNTAGQAESTRRWGLSQNPMQVQLPTSALHPLEDLTQEDTHYSQTVSNILQNQFTRWPASPSSVGYVSYSTQSAFAKWSSRASHHHFHPAAAAAADGTSQCILKYILFTVPYLHAKNPGERSAAGGAQRQPRAGRAPPPREAEREVHNPAVAGPLRDQNGQGVDIGRHHRVREAVAAEDPGARGALYIYIAVQRTSSSSSKEQQRSGVTMTEKRKVRIVEGVVAKAKAVEAEATTSVQVSIIESDALLEIECRHKEGLLLDVMQMLREVRIEVIGVQSSLNNGVFVAELRAKVKEHANGKKVSIVEVKRALNQIIPHAVD

SEQ ID NO: 1139 - DNA, 1713 bp, Glycine max
  Glyma02g16670.1
atgactgcgccactagacactggccttcaaagcatgttgcaggctgcggtgcaatctgttcactggacttacagcctcttctggcaactttgtccacagcaagtgattctggtttggggtgatggttactacaatggagcaattaagacacggaagacggtgcaaccaatggaggtgagtgctgaggaggcttctctccaaagaagtcagcaacttagagaactttatgaatcattgtccgtcggagagacaaatccgccgactcgccggccttgtgctgccttgtcgccggaggacttaacagaatctgaatggttctatttgatgtgtgtctcattctcctttcctcctggtgttgggttgcctggaaaggcatatgccaggaggcagcatctatggctcactggtgcaaacgaggtggacagcaaaacattttcacgagctattctagccaagaccgtggtgtgcattcctttattggatggcgtcgttgaatttgggacaacagataaggttcaagaagatcttagcttcatccaacacgtgaagacttttttcatagaccatctcatccctctcaggccaaagcctgccctatcggagcactcaacctccaaccctacctcctccgaccacatccccacagtcatgatattgaagaggaagaggaggaggaagaagaggacgagaccatcaacggtggcagagcccagcgagctgatgcagctggagatgccagaggacattcgactcgggtcgccgaacgatggatcaaacaacctggactcagactttcatttgcttgcggtgagccagggtggcaatgaggcaaggcaggctgagtcaactcgaaggtggagctcaagtcaagaacccatgcaagttcaactaccgacttcagaagacttgacccaagaggacactcactactctcaaacggtgtccaacatcctccaaaaccagaccacacggtggctcgcctcaccctcctccattggctacaacacatactccacgcattcggcattcgcaaaatggagcagccgcgccagccaccacttccacccggcggcggacggcaccagccagtggctcctcaagtacatcctcttcacggacgagctcagtgcgaaccacgtgctggccgagcgccgccgccgcgagaagctgaatgagaggttcataatcctgcggtcgctggtccccttcgtgaccaaaatggacaaggcgtcgatattgggagacaccatcgagtacgtgaagcagttgcggcggaagatccaggagctcgaggcgcagcgtgtttggttttacaatacggtagcagttcagaggacgagtagcagttcgagcaaggagcaacagaggagtggggtgacgatgatggaaaagaggaaggtgaggatcgtggaaggggtagcggcgaaggcaaaggcagtggaagttgaggccaccacgtcggtgcaagtttcgatcatagagagcgacgcgctgttggagattgagtgtcgtcacagagaagggttacttctggacgtgatgcagatgctgagggaggtgaggatagaggttataggggtgcagtcttcgcttaacaatggggtgttcgtggcggagttgagggctaaggtgaaggagcatgcaaacgggaagaaggtcagcattgtggaagtgaagagggcacttaaccaaattataccccatgccgttgac

SEQ ID NO: 1140 - protein, 571 aa, Glycine max
  Glyma02g16670.1  polypeptide
MTAPLDTGLQSMLQAAVQSVHWTYSLFWQLCPQQVILVWGDGYYNGAIKTRKTVQPMEVSAEEASLQRSQQLRELYESLSVGETNPPTRRPCAALSPEDLTESEWFYLMCVSFSFPPGVGLPGKAYARRQHLWLTGANEVDSKTFSRAILAKTVVCIPLLDGVVEFGTTDKVQEDLSFIQHVKTFFIDHLIPLRPKPALSEHSTSNPTSSDHIPTVMILKRKRRRKKRTRPSTVAEPSELMQLEMPEDIRLGSPNDGSNNLDSDFHLLAVSQGGNEARQAESTRRWSSSQEPMQVQLPTSEDLTQEDTHYSQTVSNILQNQTTRWLASPSSIGYNTYSTHSAFAKWSSRASHHFHPAADGTSQWLLKYILFTDELSANHVLAERRRREKLNERFIILRSLVPFVTKMDKASILGDTIEYVKQLRRKIQELEAQRVWFYNTVAVQRTSSSSSKEQQRSGVTMMEKRKVRIVEGVAAKAKAVEVEATTSVQVSIIESDALLEIECRHREGLLLDVMQMLREVRIEVIGVQSSLNNGVFVAELRAKVKEHANGKKVSIVEVKRALNQIIPHAVD

SEQ ID NO: 1141 - DNA, 1860 bp, Vitis vinifera
  GSVIVT01011123001
atggctgcgccgccgaatagccggcttcagagtatgttgcagtcggcggtgcaatcagttcgatggacttacagtctattctggcaaatctgtccccagcaagggatcttagtgtggggagatgggtattacaatggggcaatcaagactaggaagacggtgcaaccaatggaggtcagcgccgaggaggcgtccctccagagaagccagcagctaagggaactctacgaatcgctgtctgctggagaaaccaaccagccagcaaggcggccatgtgccgccttgtcgccggaggacttgaccgagtcggagtggttctacctgatgtgtgtctctttctcatttcctcctggggtggggttaccgggaaaggcatatgcaaagcggcaccatatatggcttgcaggagcaaatgaggtcgatagcaaagtcttctctagagctattcttgctaagagtgctcgcgtacagactgtggtttgcattcctttaatggatggcgtggttgaatttggcaccactgagaaggttcaagaggaccttggattcgtccaacatgtaaaaagcttcttcacagatcatcaactccacaaccacccccctaagccagcactctccgagcactccacttcgaatcccgccacctcatcagaccactcgcaggaggaggaggaggaggaggaagaggaggaggaggaggaagaggaagaagaagaagctgagtccgactcggaggcggaaacggggcgaaacaatcgcaggctcatacaactagaaatgtcggagggcatacggctgggatcaccagatgacggctccaacaatctggactcagactttcacatgctggctgtgagccagccagggagctcacctccaccacaaccaccgacagggccccctccattggatgaattatcacatgaggacacacactattcacaaaccgtctcaaccatccttcaacaccagccgaaccggtggtcggagtcgtcgtcgtccggatgcattgcgccatactccagccaatcagcgtttgccaagtggactacccgctgcgaccatcaccaccaccccatggctgtggagggcacctcccagtggctgctcaaatacatcctctttagcgttcccttcctccacaccaagtaccgcgacgagaactctccgaaatcccgcgacggcgactccgccggtcggttccgcaagggaacgcctcaggacgagctcagcgccaaccacgtcctcgccgaacgccgccgccgcgagaagctcaacgagcggttcatcatactcagatcgctggtgccgttcgtgacgaaaatggacaaggcttcgattctcggagacacgatagagtacgtgaagcagcttcggaagaaaatccaagatctggaggctcgaacacggcagatggaggtggaacagcgatcgagaggatccgattcggttaggtcaaaggagcatcgcatcgggtccggcggtgtagatcggaacagggcggtggtggcagggtcagacaaaaggaagttgaggatagttgaggggagcaccggcgcgaagccaaaggtggtggattcaccaccggcagcggtggaaggcggaacaaccaccgtggaggtgtcgataatagagagtgacgcattgttggagatgcaatgtccgtacagggaagggctgttgctggatgtaatgcagatgctccgagaccttcggctcgaaacgacgacggttcagtcgtcgttaaccaatggggtcttcgtggccgaattaagggctaaggtgaaggagaatgccagtgggaagaaggcaagcattatggaagtaaagagggcaataaaccaaataataccccagtgc

SEQ ID NO: 1142 - protein, 620 aa, Vitis vinifera
  GSVIVT01011123002  polypeptide
MAAPPNSRLQSMLQSAVQSVRWTYSLFWQICPQQGILVWGDGYYNGAIKTRKTVQPMEVSAEEASLQRSQQLRELYESLSAGETNQPARRPCAALSPEDLTESEWFYLMCVSFSFPPGVGLPGKAYAKRHHIWLAGANEVDSKVFSRAILAKSARVQTVVCIPLMDGVVEFGTTEKVQEDLGFVQHVKSFFTDHQLHNHPPKPALSEHSTSNPATSSDHSQEEEEEEEEEEEEEEEEEEAESDSEAETGRNNRRLIQLEMSEGIRLGSPDDGSNNLDSDFHMLAVSQPGSSPPPQPPTGPPPLDELSHEDTHYSQTVSTILQHQPNRWSESSSSGCIAPYSSQSAFAKWTTRCDHHHHPMAVEGTSQWLLKYILFSVPFLHTKYRDENSPKSRDGDSAGRFRKGTPQDELSANHVLAERRRREKLNERFIILRSLVPFVTKMDKASILGDTIEYVKQLRKKIQDLEARTRQMEVEQRSRGSDSVRSKEHRIGSGGVDRNRAVVAGSDKRKLRIVEGSTGAKPKVVDSPPAAVEGGTTTVEVSIIESDALLEMQCPYREGLLLDVMQMLRDLRLETTTVQSSLTNGVFVAELRAKVKENASGKKASIMEVKRAINQIIPQC

SEQ ID NO: 1143 - DNA, 2046 bp, Eucalyptus grandis
  Eucgr.H01487.1
atggcaaccccgccgagcagccggcttcagtccatgttgcagtccgccgtgcaatccataaaatggagttacagtctcttctggcaaatctgcccccaacaagggatattgatatggggagatgggtactacaatgggccgatcaagacccgaaaaaccgtccagccgatggaagtcagcgcggaggaggcctccctccagcggagccagcagctccgggagctctatgagtcgctctccgccggcgagacgaaccagccggcacgccgcccatgtgcggccctctcgccagaggacttgaccgagaccgagtggttctacttgatgtgcgtctccttctcatttcctcctggggctggcttgcctggaaaagcgtacgcgaggaggcagcatgcgtggctcaccggagctaatgaggttgatagcaagactttttcgagagctattcttgcaaagagtgctcgtattcagaccgtggtttgcatccctcttctagacggcgtagtggaatttggcaccacggaaagggttcaagaggacatttcactcgtcaatcatgtcaaaaccttcttcgttgaccaccacccccctcacccaccgaaacccgccctttccgaacactcgacctccaaccccgccgccacctcgtccggccaccaccgcttccactccccgcccgtcccctcctacgccccggccgatccacccgctgcagccaaccaaggggatgaggaggaagaggacgacgacgacgacgacgaggagggagagtccgactccgaggccgagaccggccggcagggggcggcggcggcagcgcagaaccctcacggcgcagggcccgcaaacaacgccgagcccagtgagttcgagatgtctgaggacatccggctcggctcgccagacgacgggtcaaacaacctggactcggacttccccatgctgaccataaactcgacggccgcggaccaccagcgccaggttgactcgttccgggccgagacgacccggaggtggcagatgatgcaggatccagcgaggagtggccttcaaaccccgccgtcagttcctccggcgctagacgagctgtcgcaggaggacacccactactcccagaccgtctcgaccatcctccagaaccagccgcggtgggccgactccaccagctacgtctcctactccacccaatcggcgttctccaagtggacaagccgctccgaccacctcctccacgtcccggccgagggcacctcccagtggctcctgaagtacatcctgttcaccataccgttcctgcacaccaagtaccgcgacgagaactcgcccaagtcccgggacggcgactccagctcgcggttccgcaaagggaacccgcaggacgagctcagcgccaaccatgtcctggcggagcgccgccgccgcgagaagctcaacgagaggtttattatactgaggtcactggtgccgttcgtgaccaaaatggataaggcctccatattgggggataccatagaatatgtgaagcaacttaggaagaagatccaagatctcgaggcgaggaatcgacaaatggaggctgaccacaggacaaaggaaggagagttgcagaggacgactagtttgaaggatctacgaagcgcggcctcgtcagtagaacggtcctcccgagcaagcttgcctgggtctgggtctgacaagaggaaaatgaggatcgtcgagggcggcagcggggccaagcccaaggccgtggagtcgccgccacctcctctcccgcccccgacatccgagactagcgtgcaagtgtcgatcatcgagagcgatgcactgttggagctccaatgcccgcatagagaagggttgttgctcgacctaatgcaaatgctccgagatctgaggatcgagacgacggcggtccaatcctcgttgacaaacgggttcttcgtggccgaattgagagccaaggtaaaggaaaatgtcaatgggaagaaggcgagtattgttgaggtaaagagagcaattcaacagctcattccccacacagactcc

SEQ ID NO: 1144 - protein, 682 aa, Eucalyptus grandis
  Eucgr.H01487.2  polypeptide
MATPPSSRLQSMLQSAVQSIKWSYSLFWQICPQQGILIWGDGYYNGPIKTRKTVQPMEVSAEEASLQRSQQLRELYESLSAGETNQPARRPCAALSPEDLTETEWFYLMCVSFSFPPGAGLPGKAYARRQHAWLTGANEVDSKTFSRAILAKSARIQTVVCIPLLDGVVEFGTTERVQEDISLVNHVKTFFVDHHPPHPPKPALSEHSTSNPAATSSGHHRFHSPPVPSYAPADPPAAANQGDEEEEDDDDDDEEGESDSEAETGRQGAAAAAQNPHGAGPANNAEPSEFEMSEDIRLGSPDDGSNNLDSDFPMLTINSTAADHQRQVDSFRAETTRRWQMMQDPARSGLQTPPSVPPALDELSQEDTHYSQTVSTILQNQPRWADSTSYVSYSTQSAFSKWTSRSDHLLHVPAEGTSQWLLKYILFTIPFLHTKYRDENSPKSRDGDSSSRFRKGNPQDELSANHVLAERRRREKLNERFIILRSLVPFVTKMDKASILGDTIEYVKQLRKKIQDLEARNRQMEADHRTKEGELQRTTSLKDLRSAASSVERSSRASLPGSGSDKRKMRIVEGGSGAKPKAVESPPPPLPPPTSETSVQVSIIESDALLELQCPHREGLLLDLMQMLRDLRIETTAVQSSLTNGFFVAELRAKVKENVNGKKASIVEVKRAIQQLIPHTDS

SEQ ID NO: 1145 - DNA, 2016 bp, Eucalyptus grandis
  Eucgr.H01487.2
atggcaaccccgccgagcagccggcttcagtccatgttgcagtccgccgtgcaatccataaaatggagttacagtctcttctggcaaatctgcccccaacaagggatattgatatggggagatgggtactacaatgggccgatcaagacccgaaaaaccgtccagccgatggaagtcagcgcggaggaggcctccctccagcggagccagcagctccgggagctctatgagtcgctctccgccggcgagacgaaccagccggcacgccgcccatgtgcggccctctcgccagaggacttgaccgagaccgagtggttctacttgatgtgcgtctccttctcatttcctcctggggctggcttgcctggaaaagcgtacgcgaggaggcagcatgcgtggctcaccggagctaatgaggttgatagcaagactttttcgagagctattcttgcaaagagtgctcgtattcagaccgtggtttgcatccctcttctagacggcgtagtggaatttggcaccacggaaagggttcaagaggacatttcactcgtcaatcatgtcaaaaccttcttcgttgaccaccacccccctcacccaccgaaacccgccctttccgaacactcgacctccaaccccgccgccacctcgtccggccaccaccgcttccactccccgcccgtcccctcctacgccccggccgatccacccgctgcagccaaccaaggggatgaggaggaagaggacgacgacgacgacgacgaggagggagagtccgactccgaggccgagaccggccggcagggggcggcggcggcagcgcagaaccctcacggcgcagggcccgcaaacaacgccgagcccagtgagttcgagatgtctgaggacatccggctcggctcgccagacgacgggtcaaacaacctggactcggacttccccatgctgaccataaactcgacggccgcggaccaccagcgccaggttgactcgttccgggccgagacgacccggaggtggcagatgatgcaggatccagcgaggagtggccttcaaaccccgccgtcagttcctccggcgctagacgagctgtcgcaggaggacacccactactcccagaccgtctcgaccatcctccagaaccagccgcggtgggccgactccaccagctacgtctcctactccacccaatcggcgttctccaagtggacaagccgctccgaccacctcctccacgtcccggccgagggcacctcccagtggctcctgaagtacatcctgttcaccataccgttcctgcacaccaagtaccgcgacgagaactcgcccaagtcccgggacggcgactccagctcgcggttccgcaaagggaacccgcaggacgagctcagcgccaaccatgtcctggcggagcgccgccgccgcgagaagctcaacgagaggtttattatactgaggtcactggtgccgttcgtgaccaaaatggataaggcctccatattgggggataccatagaatatgtgaagcaacttaggaagaagatccaagatctcgaggcgaggaatcgacaaatggaggctgaccacaggacaaaggaaggagagttgcagaggacgactagtttgaaggatctacgaagcgcggcctcgtcagtagaacggtcctcccgagcaagcttgcctgggtctgggtctgacaagaggaaaatgaggatcgtcgagggcggcagcggggccaagcccaaggccgtggagtcgccgccacctcctctcccgcccccgacatccgagactagcgtgcaagtgtcgatcatcgagagcgatgcactgttggagctccaatgcccgcatagagaagggttgttgctcgacctaatgcaaatgctccgagatctgaggatcgagacgacggcggtccaatcctcgttgacaaacgggttcttcgtggccgaattgagagccaaggtaatgccctcttacattttcggagttctaggttttgattggctctttcggtct

SEQ ID NO: 1146 - protein, 672 aa, Eucalyptus grandis
  Eucgr.H01487.2 polypeptide
MATPPSSRLQSMLQSAVQSIKWSYSLFWQICPQQGILIWGDGYYNGPIKTRKTVQPMEVSAEEASLQRSQQLRELYESLSAGETNQPARRPCAALSPEDLTETEWFYLMCVSFSFPPGAGLPGKAYARRQHAWLTGANEVDSKTFSRAILAKSARIQTVVCIPLLDGVVEFGTTERVQEDISLVNHVKTFFVDHHPPHPPKPALSEHSTSNPAATSSGHHRFHSPPVPSYAPADPPAAANQGDEEEEDDDDDDEEGESDSEAETGRQGAAAAAQNPHGAGPANNAEPSEFEMSEDIRLGSPDDGSNNLDSDFPMLTINSTAADHQRQVDSFRAETTRRWQMMQDPARSGLQTPPSVPPALDELSQEDTHYSQTVSTILQNQPRWADSTSYVSYSTQSAFSKWTSRSDHLLHVPAEGTSQWLLKYILFTIPFLHTKYRDENSPKSRDGDSSSRFRKGNPQDELSANHVLAERRRREKLNERFIILRSLVPFVTKMDKASILGDTIEYVKQLRKKIQDLEARNRQMEADHRTKEGELQRTTSLKDLRSAASSVERSSRASLPGSGSDKRKMRIVEGGSGAKPKAVESPPPPLPPPTSETSVQVSIIESDALLELQCPHREGLLLDLMQMLRDLRIETTAVQSSLTNGFFVAELRAKVMPSYIFGVLGFDWLFRS

SEQ ID NO: 1147 - DNA, 1995 bp, Brachypodium distachyon
  Bradi1g54070.1
atggcgagctgcagcgaggtgcacaagtctctgcaggccgtggcgcaggggctgcggtggacgtacgccctcctctggcagctctgccccgaccaaggggcgctggtgtgggcggaggggcactacaacggggccatcaagacgcgcaagacggtgcagcaggctcacgggcatggggcgccggcgcccgcggaccaggcggcgcggcaccggagccggcagctcaaggagctcttcgagtcgctggctagagaggctgctgcctgcggcggccccggtgggattatgatgatgacgggctgcagggccgaggccgtccaggaggcgtcggcgcggcggcccacggcggcgctggcgccggaggacctcacggagacggagtggttctatctcatgtgcgcctcctactccttccctccccacgtcgggttacctggaagagcatttgcaaagggagggcatgtatggctctgtagggcaaatgaagttgacagcaaggtcttctcaagagcaatacttgccaagacactcgtatgtattccagttgttgatggtgtcctggaaatcgggaccacagaaaacgtgaaggaagacataagtttagttcagtatgcaatgagcatcttcatggatcaacaagacatccagatgatccctactatctcagagcattcaacttcagacaaaatctgtcacatgtatcaacagtcattccaaacaccgaggaagatacatgctggtcaggacaacgaaatggaacacgacgatgacgatatcggtgcggagtgtgcgtcgggttcagggaccaacaccgggaggaactacagccgagatgccccactgaacatcgtgggcaatactgatgatcaggcaacacccaatgcagggagcagtgagctaatgcagcttgaaattccagaaaaggtgagagatggctgctcaagcaacttggatgatgaaatcaagatgctaatggtttgccagaacagcaatgaccagtccgatttccaacggcaagatgagccttacgagtcttggcattttctttatgaggagttatgcagtggctaccctcaatcgtcaggggaaaatcaagacattgtactccaacccgaaaacgcgcactatgcagaaacagtcatgtcgatcctacagcgcaacgacacgcgccgacaagccgccagcaccaacaccagatcctacgtggcagcatcgcaccaatcatcattctccacgtggcatcctaccatgctgcagcagggacgcacggccaccggagccggaggcaccacccaacagaggatgctcgggagcctcctgttcaacaatgctgctgctgctgcaagcggctacggcaagccggccgacgatattcgcggcgaaggcgggccgcggagagaggcggcggacttgagcgccaaccatgtcctgcaggagcggaagagaagagagaagctcaacgagcggttcatcatcctccgctccctcgtacccttcgtgaccaagatggacaaggcgtcgatcctgggggacacgatcgagtacgtgaagcagctgaggagccgcatccaggacctcgagtcatcgtcaaccaggcagcagcagcagcaggtccacggcggcggcggcggcgagctggcgaggagcgcgaagcggaagatggcgaccagggcggccgtggaagggtgcagcgcgagcagcagcagcagcagtgccccgccgtcgtcgtcgttggcggcggcggccgaggtgcaggtgtccatcatcgagagcgacgcgctgctggagctccggtgccccgaccggcgcgggctgctgctccggatcatgcaggcggtgcaggaccagctccggctcgacgtcacggccgtcagggcctcgtccgacgacggcgtgctgctcgccgaactgcgcgccaaggtgagggaggtgcacgggaggaggagcagcatttcggaagtgaagagagccatccatctcatcatctcgtcagga

SEQ ID NO: 1148 - protein, 665 aa, Brachypodium distachyon
  Bradi1g54070.1  polypeptide
MASCSEVHKSLQAVAQGLRWTYALLWQLCPDQGALVWAEGHYNGAIKTRKTVQQAHGHGAPAPADQAARHRSRQLKELFESLAREAAACGGPGGIMMMTGCRAEAVQEASARRPTAALAPEDLTETEWFYLMCASYSFPPHVGLPGRAFAKGGHVWLCRANEVDSKVFSRAILAKTLVCIPVVDGVLEIGTTENVKEDISLVQYAMSIFMDQQDIQMIPTISEHSTSDKICHMYQQSFQTPRKIHAGQDNEMEHDDDDIGAECASGSGTNTGRNYSRDAPLNIVGNTDDQATPNAGSSELMQLEIPEKVRDGCSSNLDDEIKMLMVCQNSNDQSDFQRQDEPYESWHFLYEELCSGYPQSSGENQDIVLQPENAHYAETVMSILQRNDTRRQAASTNTRSYVAASHQSSFSTWHPTMLQQGRTATGAGGTTQQRMLGSLLFNNAAAAASGYGKPADDIRGEGGPRREAADLSANHVLQERKRREKLNERFIILRSLVPFVTKMDKASILGDTIEYVKQLRSRIQDLESSSTRQQQQQVHGGGGGELARSAKRKMATRAAVEGCSASSSSSSAPPSSSLAAAAEVQVSIIESDALLELRCPDRRGLLLRIMQAVQDQLRLDVTAVRASSDDGVLLAELRAKVREVHGRRSSISEVKRAIHLIISSG

SEQ ID NO: 1149 - DNA, 1215 bp, Zea mays
  GRMZM2G042733_T01
atggcggccggcggcagcggaggcgaggccgcgcagaaggcgctgcagtcggtggcgcagagcacggggtggacgtacagcctcctctggcgcctctgcccgcgccaaggcgcgctggtctgggcggagggctactacaacggcgccatcaggacgcgcaagacgacgatgacgacagtgcgtcagccggcgggcgcggaggacgccggggacgaggagacggcgctgcgccgcagccggcagctcaaggagctctacgactcgctggcggcgggggaggccgcttacgacggtggtggaggagtcggcgacccacagcagcagcaccagcagcaggtggcggtggtgccgccgcctcgccggcccgtcgccgcgctggcgcccgaggacctgacggagacggagtggttctacctcatgtgcgcctcctactgcttccctcctgccgtcgggttgcccggggaggcgtttgtaaggagagctcatgtgtggctatgtggtgcaaacaaagctgacagcaaggtgttctcaagagcaattctcgctaggacagtagcatgcattccagtcgacgatggtgtcctggaaattggaactacagaaaaggtagaagaagacattttcttaattcaacatgttaggaacatcttcgtggatcaacatggcgcccacataatgcctaccaccctctcagggtattcaacttccaccccaaccacacagcttaatcatcagccattccagacaaaaacaggaatcagtctcaatctaggagacgagcataatagtgaaatggaagatgatgacgacggcaggattgatttagagaacaatactgaaaatgattcaacaaggcggcatttgccacaggacgccagtgtaggcaatgagctggaaacgctcaatgcagagagcagtgggccgatgctgattgctaatctgacagcgcaggatgaatattgtccgttgcatcgttttcacagtgaagacctaagcagtaaatacctacagtcatcaggggcagaagatcaagcagcagtagcggaaaacgcacactacatcaaaacggtccttacaatcctacggttcaacgcgtgccggcaaacgcaagcaggcctcctcaaacatcgccaaaacctacctggcactctccaagaactcgccattctcaaaatggaactggaagcgcaaaggaataagcagcatgttgatccc

SEQ ID NO: 1150 - protein, 405 aa, Zea mays
  GRMZM2G042733_T01  polypeptide
MAAGGSGGEAAQKALQSVAQSTGWTYSLLWRLCPRQGALVWAEGYYNGAIRTRKTTMTTVRQPAGAEDAGDEETALRRSRQLKELYDSLAAGEAAYDGGGGVGDPQQQHQQQVAVVPPPRRPVAALAPEDLTETEWFYLMCASYCFPPAVGLPGEAFVRRAHVWLCGANKADSKVFSRAILARTVACIPVDDGVLEIGTTEKVEEDIFLIQHVRNIFVDQHGAHIMPTTLSGYSTSTPTTQLNHQPFQTKTGISLNLGDEHNSEMEDDDDGRIDLENNTENDSTRRHLPQDASVGNELETLNAESSGPMLIANLTAQDEYCPLHRFHSEDLSSKYLQSSGAEDQAAVAENAHYIKTVLTILRFNACRQTQAGLLKHRQNLPGTLQELAILKMELEAQRNKQHVDP

SEQ ID NO: 1151 - DNA, 2067 bp, Setaria italica
  Si029106m
atggcggcggcggcggcggagggcggtgaggccgtggcggtgcagaaggcgctgcaggcggtggcggagggcacggggtggacgtacgccgccctctggcgcctgtgcacgcgccagggggcgctggtgtgggcggaggggcactacaacggcgccatcaagacgcgcaagaccaccgtggcgccgggcggcggtggcgaggaggaggaagaggaggaggggacggcggcgcggcggcggcgcagccggcagctgcgggagctctacgactcgctggcggcgggggcggaggccgacggtggtggaggaggaggaggtggcggaagcggcagcggcagggaggacggcgccgtcgtggctcgccggtcgagcgccgcgctggcgccggaggacctctcggagacggagtggttctacctcatgtgcggctcctactgcttccctccgggcctcgggttgcctggggaggcatttgcaaggagaggtcatgtgtggctcagtggggcaaacaaagttaacagcaaagtgttttcaagggcaatccttgccaggacagtcgcatgcattccagttaatgaggatggtgtcctggaaattggaactacagagaaggtagatgaagacattggtttaattgagtatgctaggagcatcttcatggatcaacatggcattcccataatgcctaccctctcagggcattcaacttccaccccatccacacacatcaatcatcagccatcccaaataaaaatagaaaaatacattggcggcagaaatgtacggcctaataatctcaatccagaagaggagcacattgaaacggaagatgacaaccacatgattgattcagaaaccaatactgaaaatgattcatgccggcatctgccgctgggcaatgtgggcaatggtcaggcagggcccaatgcacggagcagtgatgaaccgatgcagattgagacgtcggaaagcttaagggatggttgcacaaaccacgtggatgaagagatcccaatgctcatggcttgccagaacggtgatcatccagaacaggatgaattaggttcatggcattttctctatgaagacctaatgaacaataaatgcctacaatcctcagcggcacaagacccagcagtactagccgaaaacgcgcactacatcgaagcagtcctgacaatcttacggcacaacgcgtgccggcaagcgcaagcagcggcctcgaacaccagaacctacgacctggcgatatccaagaactcaccattctcaagatggaaccctaataaaggaaccagcgatcttcagaggatgctgatctctgaaggcaccccacagagaatgctcaagagcatcctgttcaccagtgcccctactagatgcagcagtcaccaaaggcacagaggagaggccacccagtcaccggaggagcccgccggcagggacgacggcgacggcaccggccggtcacggagaggacaaggacaggcccaggctgagctgagtgccagccatgttctcaaggagcggcagaggagggagaagctcaatgagaggttcattatcctccggtcgcttgtgccgttcgtgacgaagatggacagggcgtcgatcctgggcgacacgatcgagtacgtgaaacagctgcggcgacgcatccaggacctggagtcattacgagcctcgaaggagaagagagctcagagcacgagctcggcgacaatggcggaggcgtggagtaaggtgagagccgtggaagcgagcagcagctgcagcaccagcggcgcgggcaggccggcgtcggtggcgagcacggaggtgcaggtgtccatcatcgagagcgacgcgctggtggagctccggtgcccgcgcagggacgggctcctgctccgggtcatgcaggcgctgcaccgggagctcgggctggaggtcacctccgtccaggcctcgtcggccggcgacgtcctgctcgtggagctgcgcgcaaaggtgaaggaggtgcatggggggaggagcaccatcaacgaagtgaagagaacgatccatctaatcatctcatcgtcaggc

SEQ ID NO: 1152 - protein, 689 aa, Setaria italica
  Si029106m  polypeptide
MAAAAAEGGEAVAVQKALQAVAEGTGWTYAALWRLCTRQGALVWAEGHYNGAIKTRKTTVAPGGGGEEEEEEEGTAARRRRSRQLRELYDSLAAGAEADGGGGGGGGGSGSGREDGAVVARRSSAALAPEDLSETEWFYLMCGSYCFPPGLGLPGEAFARRGHVWLSGANKVNSKVFSRAILARTVACIPVNEDGVLEIGTTEKVDEDIGLIEYARSIFMDQHGIPIMPTLSGHSTSTPSTHINHQPSQIKIEKYIGGRNVRPNNLNPEEEHIETEDDNHMIDSETNTENDSCRHLPLGNVGNGQAGPNARSSDEPMQIETSESLRDGCTNHVDEEIPMLMACQNGDHPEQDELGSWHFLYEDLMNNKCLQSSAAQDPAVLAENAHYIEAVLTILRHNACRQAQAAASNTRTYDLAISKNSPFSRWNPNKGTSDLQRMLISEGTPQRMLKSILFTSAPTRCSSHQRHRGEATQSPEEPAGRDDGDGTGRSRRGQGQAQAELSASHVLKERQRREKLNERFIILRSLVPFVTKMDRASILGDTIEYVKQLRRRIQDLESLRASKEKRAQSTSSATMAEAWSKVRAVEASSSCSTSGAGRPASVASTEVQVSIIESDALVELRCPRRDGLLLRVMQALHRELGLEVTSVQASSAGDVLLVELRAKVKEVHGGRSTINEVKRTIHLIISSSG

SEQ ID NO: 1153 - protein, 198 aa, artificial sequence
  consensus sequence derived from AtMYC1 (AT4G00480.1, G581) -related sequences
  MISC_FEATURE (1)..(1): Xaa is Leu or Phe
  MISC_FEATURE (2)..(2): Xaa is any amino acid or absent
  MISC_FEATURE (3)..(5): Xaa can be any amino acid
  MISC_FEATURE (8)..(8): Xaa can be any amino acid
  MISC_FEATURE (9)..(9): Xaa is Ala or Ser
  MISC_FEATURE (10)..(10): Xaa can be any amino acid
  MISC_FEATURE (12)..(14): Xaa can be any amino acid
  MISC_FEATURE (16)..(16): Xaa is Ser or Thr
  MISC_FEATURE (18)..(18): Xaa is Gly, Ala, or Ser
  MISC_FEATURE (19)..(19): Xaa is Ile, Val, Leu or Met
  MISC_FEATURE (22)..(22): Xaa is any Ser, Ala, or Thr
  MISC_FEATURE (23)..(30): Xaa can be any amino acid
  MISC_FEATURE (32)..(32): Xaa can be any amino acid
  MISC_FEATURE (34)..(35): Xaa can be any amino acid
  MISC_FEATURE (37)..(37): Xaa can be any amino acid
  MISC_FEATURE (41)..(41): Xaa can be any amino acid
  MISC_FEATURE (42)..(42): Xaa is Ile, Val, Leu or Met
  MISC_FEATURE (44)..(44): Xaa is Thr or Lys
  MISC_FEATURE (47)..(47): Xaa can be any amino acid or absent
  MISC_FEATURE (48)..(50): Xaa can be any amino acid
  MISC_FEATURE (51)..(53): Xaa can be any amino acid or absent
  MISC_FEATURE (54)..(54): Xaa is Glu or absent
  MISC_FEATURE (55)..(55): Xaa is Ile, Met, or absent
  MISC_FEATURE (56)..(61): Xaa can be any amino acid
  MISC_FEATURE (62)..(62): Xaa is Ile, Val, Leu or Met
  MISC_FEATURE (63)..(63): Xaa can be any amino acid
  MISC_FEATURE (64)..(64): Xaa is Arg or Lys
  MISC_FEATURE (65)..(65): Xaa is Ser or Thr
  MISC_FEATURE (66)..(66): Xaa can be any amino acid
  MISC_FEATURE (66)..(66): Xaa can be any amino acid
  MISC_FEATURE (67)..(67): Xaa is Gln or Glu
  MISC_FEATURE (69)..(70): Xaa can be any amino acid
  MISC_FEATURE (72)..(72): Xaa is Tyr or Phe
  MISC_FEATURE (73)..(74): Xaa can be any amino acid
  MISC_FEATURE (75)..(75): Xaa is Ile, Val, Leu or Met
  MISC_FEATURE (76)..(78): Xaa can be any amino acid
  MISC_FEATURE (79)..(79): Xaa is Glu or Asp
  MISC_FEATURE (80)..(81): Xaa can be any amino acid
  MISC_FEATURE (82)..(103): Xaa can be any amino acid or absent
  MISC_FEATURE (104)..(109): Xaa can be any amino acid
  MISC_FEATURE (110)..(110): Xaa is Ala, Ser, or absent
  MISC_FEATURE (111)..(112): Xaa can be any amino acid
  MISC_FEATURE (114)..(114): Xaa can be any amino acid
  MISC_FEATURE (116)..(116): Xaa is Glu or Asp
  MISC_FEATURE (119)..(119): Xaa is Gly, Ala, Ser or Thr
  MISC_FEATURE (121)..(121): Xaa can be any amino acid
  MISC_FEATURE (123)..(123): Xaa can be any amino acid
  MISC_FEATURE (125)..(125): Xaa is Tyr or Phe
  MISC_FEATURE (126)..(127): Xaa is Ile, Val, Leu or Met
  MISC_FEATURE (128)..(128): Xaa is Cys or Ser
  MISC_FEATURE (130)..(130): Xaa is Ser or Thr
  MISC_FEATURE (131)..(131): Xaa is Tyr or Phe
  MISC_FEATURE (132)..(132): Xaa can be any amino acid
  MISC_FEATURE (133)..(133): Xaa is Tyr or Phe
  MISC_FEATURE (134)..(136): Xaa can be any amino acid
  MISC_FEATURE (137)..(137): Xaa is Gln or Glu
  MISC_FEATURE (138)..(138): Xaa can be any amino acid
  MISC_FEATURE (139)..(139): Xaa is Ile, Val, Leu or Met
  MISC_FEATURE (142)..(142): Xaa can be any amino acid
  MISC_FEATURE (143)..(143): Xaa is Thr, Ala, or Ser
  MISC_FEATURE (144)..(149): Xaa can be any amino acid
  MISC_FEATURE (150)..(150): Xaa is Ile, Val, Leu, Met, or Thr
  MISC_FEATURE (152)..(152): Xaa is Ile, Val, Leu, or Met
  MISC_FEATURE (153)..(153): Xaa can be any amino acid
  MISC_FEATURE (154)..(154): Xaa is Asp or Asn
  MISC_FEATURE (155)..(155): Xaa is Ala or Ser
  MISC_FEATURE (156)..(157): Xaa can be any amino acid
  MISC_FEATURE (158)..(158): Xaa is Ala or Ser
  MISC_FEATURE (159)..(160): Xaa can be any amino acid
  MISC_FEATURE (162)..(162): Xaa can be any amino acid
  MISC_FEATURE (164)..(164): Xaa can be any amino acid
  MISC_FEATURE (166)..(166): Xaa can be Ala or Ser
  MISC_FEATURE (168)..(168): Xaa is Ile, Val, Leu, or Met
  MISC_FEATURE (170)..(170): Xaa is Lys or Arg
  MISC_FEATURE (171)..(171): Xaa is Ser or absent
  MISC_FEATURE (172)..(172): Xaa is Ala or absent
  MISC_FEATURE (173)..(173): Xaa is Ser, Ala, Thr, or absent
  MISC_FEATURE (174)..(174): Xaa is Ile, Val, Leu, Met, or absent
  MISC_FEATURE (175)..(175): Xaa can be any amino acid or absent
  MISC_FEATURE (176)..(176): Xaa is Ser or Thr
  MISC_FEATURE (177)..(178): Xaa is Ile, Val, Leu, or Met
  MISC_FEATURE (180)..(180): Xaa can be any amino acid
  MISC_FEATURE (182)..(182): Xaa can be any amino acid
  MISC_FEATURE (183)..(183): Xaa can be any amino acid or absent
  MISC_FEATURE (184)..(185): Xaa can be any amino acid
  MISC_FEATURE (188)..(188): Xaa is Ile, Val, Leu, or Met
  MISC_FEATURE (190)..(190): Xaa is Ile, Val, Leu, Met, or Phe
  MISC_FEATURE (192)..(192): Xaa can be any amino acid
  MISC_FEATURE (193)..(193): Xaa is Ser or Thr
  MISC_FEATURE (194)..(194): Xaa is Glu or Asp
  MISC_FEATURE (195)..(195): Xaa can be any amino acid
  MISC_FEATURE (196)..(196): Xaa is Ile, Val, Leu, or Met
  MISC_FEATURE (197)..(197): Xaa can be any amino acid
  AtMYC1 clade concensus sequence I
XXXXXLAXXXRXXXWXYXXFWXXXXXXXXXLXWXXGXYNGXXKXRKXXXXXXXXXXXXXXXXXXXXXLXXLXXXXXXXXXXXXXXXXXXXXXXXXXXXXXXXXXXXXXXXXXLXPXDLXDXEXYXXXXMXXXXXXXXXXPGXXXXXXXXXWMXXXXXXXXKXFXRXLXAXXXXXXXXXCXPXXXXGVXEXGXXXXXXE

SEQ ID NO: 1154 - protein, 19 aa, artificial sequences
  consensus sequence derived from AtMYC1 (At4g00480.1, G581) clade and related sequences
  MISC_FEATURE (2)..(2): Xaa is Ile, Val, Leu, or Met
  misc_feature (4)..(4): Xaa can be any amino acid
  MISC_FEATURE (5)..(5): Xaa is Glu, Asp, or Asn
  MISC_FEATURE (6)..(6): Xaa is Thr or Ala
  misc_feature (8)..(8): Xaa can be any amino acid
  misc_feature (10)..(11): Xaa can be any amino acid
  MISC_FEATURE (13)..(13): Xaa is Ile, Val, Leu, or Met
  misc_feature (14)..(15): Xaa can be any amino acid
  MISC_FEATURE (16)..(16): Xaa is Arg or Lys
  MISC_FEATURE (17)..(17): Xaa is Ile, Val, Leu, or Met
SXLXXXIXYXXLXXXXXEL

SEQ ID NO: 1155 - DNA, 1539 bp, Arabidopsis thaliana
  WRKY3 (AT2G03340.1 or G878)
atggcggagaaggaagaaaaagaaccatcgaagttaaaatcatccaccggagtttcacggccaacgatttcactacctcctcgaccgtttggtgaaatgttttttagcggtggcgttggatttagtcctggaccaatgactctcgtctcaaatttattctctgatcctgatgagttcaagtctttctctcagcttttagctggagctatggcttctccggcggcagctgctgttgccgccgctgctgtggttgctactgctcatcatcagacacctgtgagctctgtcggtgatggcggtggaagcggtggtgatgttgacccgaggtttaagcagagtagaccaacgggattgatgataactcaaccaccggggatgtttactgtaccgccggggttaagtccggctactcttttggattctccgagcttctttggtcttttttcacctcttcagggaacatttggtatgacacatcaacaagctttagcacaagtcactgcacaagcagttcaaggcaataatgttcatatgcagcaatcacaacaatctgaatatccttcttctacacaacaacaacaacaacaacaacaacaagcttcattgactgagattccatcattttcttctgcacctaggtctcagattcgagcctcggttcaagaaacatcgcagggtcagagagagacttcggaaatatctgtctttgagcatcggtcacagcctcaaaatgctgacaaaccagctgatgatggatacaactggcggaaatatgggcagaagcaagtgaaggggagcgattttcctcggagttattacaaatgtacgcatccagcttgtcctgtcaagaagaaagtggagaggtcactcgatggacaagtaacggaaatcatctacaagggtcaacacaatcatgagcttcctcaaaagcgcggtaacaataacgggagttgtaaaagttctgatattgcaaatcagtttcaaacaagtaatagcagtctcaacaagagtaagagggaccaggaaacaagccaagttacaacaacagagcagatgtctgaagcaagtgatagcgaggaggttgggaatgcagagactagtgtgggagaaagacatgaggatgagcctgatcccaagcgaagaaatacagaagttcgggtttcagaaccagttgcttcatcgcatagaactgtgacagagcctaggattattgtccaaacgacgagtgaagttgacctcttagatgatggatataggtggcgcaagtatggtcagaaagtagtcaaaggaaatccttatccgaggagctactataagtgtacaacaccagattgcggagtaaggaaacatgtagagagagcagcaactgacccaaaagctgttgtaacaacatatgaaggtaaacataaccatgatgttccagctgctagaaccagcagccatcagttaagaccaaacaatcaacacaacacctcaacggttaacttcaatcatcaacagcctgttgcacgtttaaggcttaaagaagagcaaatcact

SEQ ID NO: 1156 - protein, 513 aa, Arabidopsis thaliana
  WRKY3 (AT2G03340.1 or G878) polypeptide
MAEKEEKEPSKLKSSTGVSRPTISLPPRPFGEMFFSGGVGFSPGPMTLVSNLFSDPDEFKSFSQLLAGAMASPAAAAVAAAAVVATAHHQTPVSSVGDGGGSGGDVDPRFKQSRPTGLMITQPPGMFTVPPGLSPATLLDSPSFFGLFSPLQGTFGMTHQQALAQVTAQAVQGNNVHMQQSQQSEYPSSTQQQQQQQQQASLTEIPSFSSAPRSQIRASVQETSQGQRETSEISVFEHRSQPQNADKPADDGYNWRKYGQKQVKGSDFPRSYYKCTHPACPVKKKVERSLDGQVTEIIYKGQHNHELPQKRGNNNGSCKSSDIANQFQTSNSSLNKSKRDQETSQVTTTEQMSEASDSEEVGNAETSVGERHEDEPDPKRRNTEVRVSEPVASSHRTVTEPRIIVQTTSEVDLLDDGYRWRKYGQKVVKGNPYPRSYYKCTTPDCGVRKHVERAATDPKAVVTTYEGKHNHDVPAARTSSHQLRPNNQHNTSTVNFNHQQPVARLRLKEEQIT

SEQ ID NO: 1157 - DNA, 1542 bp, Arabidopsis thaliana
  AT1G13960.1
atgtcggaaaaggaagaagctccgtcgacatcgaagtccaccggagctccgtcgcgtccgactttatctcttcctccacggccgtttagtgagatgttctttaacggtggcgttggattcagtcctggtccgatgactctggtctctaatatgttccctgattccgatgagtttaggtctttctctcagcttctcgctggagccatgtcttctccagcgactgcagctgctgctgctgctgctgcgacggctagtgattaccagagacttggtgaagggactaatagctctagtggtgatgttgacccgagattcaagcaaaacagaccaaccggtttgatgatttctcaatctcaatcgccgtcgatgttcaccgtaccgcctggtttaagtccagctatgttgctcgattcaccaagctttttgggtcttttctctcccgttcagggatcatatggaatgacacatcagcaagctctagctcaagtcactgctcaagcagttcaagccaatgccaatatgcaaccacaaacagagtaccctcctccctctcaagttcaatcattttcatcgggtcaagcgcagatcccgacctcggctccactaccagctcaaagagaaacctcagatgtaaccatcatagagcacaggtcacaacagcctctaaatgttgacaaaccagctgatgatggctataactggcgaaaatatgggcaaaagcaagttaaaggtagcgagtttccacgaagctattacaagtgtactaatccaggatgtcctgtcaagaagaaggttgagagatctcttgatggacaagtaacggagattatctacaaaggtcagcacaatcatgaacctcctcaaaacactaagcgaggtaacaaagataacaccgcgaatataaatgggagttcgataaataacaatcgcgggagttctgaattgggggcatcacagtttcaaactaatagctccaacaagactaagagagagcaacatgaagcagtaagtcaagctacgacaacagagcacttgtctgaggcaagtgacggtgaagaagttggtaatggagaaactgatgtgagagagaaagatgagaatgagcctgatcccaagagaagaagtacagaagttcggatttcagaaccagctcctgctgcttcacatagaactgtgacagagcctagaattattgtccaaacgacgagtgaagttgatcttctagatgatggatataggtggcgtaaatatggacagaaagttgtcaaagggaatccttatccgaggagctactacaagtgcacaacaccaggatgtggtgtgaggaaacatgtagagagagcagcaacagatccaaaagctgtagtaacaacatatgaaggaaaacataaccatgaccttcccgctgctaaatcaagcagccatgccgctgcagcggcacagttaaggccagataatcgacctggcggtttggctaacttaaatcaacagcagcagcaacagcccgttgcgcggctaaggcttaaagaagagcaaacaact

SEQ ID NO: 1158 - protein, 514 aa, Arabidopsis thaliana
  AT1G13960.1 polypeptide
MSEKEEAPSTSKSTGAPSRPTLSLPPRPFSEMFFNGGVGFSPGPMTLVSNMFPDSDEFRSFSQLLAGAMSSPATAAAAAAAATASDYQRLGEGTNSSSGDVDPRFKQNRPTGLMISQSQSPSMFTVPPGLSPAMLLDSPSFLGLFSPVQGSYGMTHQQALAQVTAQAVQANANMQPQTEYPPPSQVQSFSSGQAQIPTSAPLPAQRETSDVTIIEHRSQQPLNVDKPADDGYNWRKYGQKQVKGSEFPRSYYKCTNPGCPVKKKVERSLDGQVTEIIYKGQHNHEPPQNTKRGNKDNTANINGSSINNNRGSSELGASQFQTNSSNKTKREQHEAVSQATTTEHLSEASDGEEVGNGETDVREKDENEPDPKRRSTEVRISEPAPAASHRTVTEPRIIVQTTSEVDLLDDGYRWRKYGQKVVKGNPYPRSYYKCTTPGCGVRKHVERAATDPKAVVTTYEGKHNHDLPAAKSSSHAAAAAQLRPDNRPGGLANLNQQQQQQPVARLRLKEEQTT

SEQ ID NO: 1159 - DNA, 1365 bp, Glycine max
  Glyma01g06550.1
atggctggcggcggaggtggggaccggccgccgtggaaggaggcggcgccgccacgacccaccatcactctgccgccgcggtcgggttccatggagacccttttcaatggagggttcagccctggtcccatgactctgctttctggctttttgggtgatggggatgatggaaagtccttctctcagctcctcgccggagctatggcttctccggtggccggagctgtcgccgacggagtgatggactcacctagtctcttttcaccttctcaggtgtcttttggaatgacacaccagcaggccctaacacaggtctcagctcaggcttcacaagccaactcaaatatgcatatccaggctgaacattcattgacacaggcttctgcagctactttcaatacaacacaacagctgattccacccttaaatgcagactcttgggccacaatgactgaatcagcagatcattctcattctgaacaaagattgcaatcttcattgttgaatgttgataagccggcagatgatggctacaactggaggaagtatggacagaaacaggtgaagggtagtgagtttcctcgaagttattacaagtgcacgcatccaaactgttctgtcaagaaaaaggtcgagcgctcacttgagggtcatgtaactgcaattatttataaaggagaacacaaccatcaacgtcctcatcctaacaagcgctcaaaagacaccatgacttcaaatgcaaattcaaatatccaagggagtgtagattcaacttatcaagggacaactacgaactcgatgtctaagatggatccagagtcaagtcaggcaacagctgatcatctatcaggaacaagtgaaagcgaggaagtaggcgatcatgaaaccgaagtggatgagaaaaatgttgagcctgaccccaagaggagaaaagcagaagtctcgcagtcagatccagcttcttcacataggactgtcactgagcctcgaatcattgtgcaaacaacaagtgaagttgatctcttggatgatgggtatagatggcgaaaatatgggcagaaagttgtcaaaggcaacccttatcctaggagctattacaaatgtacaacccaaggttgcaatgtgcggaagcacgtggagagggcttcaacagatcctaaagctgtcataacaacatatgaaggaaaacacaatcatgatgtgccagcagctaagaataacagccacactatggccagcaatactgcatcacagttaaaatcgcataataccaatcctgagaagcataattttggcagcagaggtatgggaggaaatgaacaacagccggttgcacggcttcggttgaaggaagagcagatcacc

SEQ ID NO: 1160 - protein, 455 aa, Glycine max
  Glyma01g06550.1 polypeptide
MAGGGGGDRPPWKEAAPPRPTITLPPRSGSMETLFNGGFSPGPMTLLSGFLGDGDDGKSFSQLLAGAMASPVAGAVADGVMDSPSLFSPSQVSFGMTHQQALTQVSAQASQANSNMHIQAEHSLTQASAATFNTTQQLIPPLNADSWATMTESADHSHSEQRLQSSLLNVDKPADDGYNWRKYGQKQVKGSEFPRSYYKCTHPNCSVKKKVERSLEGHVTAIIYKGEHNHQRPHPNKRSKDTMTSNANSNIQGSVDSTYQGTTTNSMSKMDPESSQATADHLSGTSESEEVGDHETEVDEKNVEPDPKRRKAEVSQSDPASSHRTVTEPRIIVQTTSEVDLLDDGYRWRKYGQKVVKGNPYPRSYYKCTTQGCNVRKHVERASTDPKAVITTYEGKHNHDVPAAKNNSHTMASNTASQLKSHNTNPEKHNFGSRGMGGNEQQPVARLRLKEEQIT

SEQ ID NO: 1161 - DNA, 1365 bp, Glycine max
  Glyma02g12490.1
atggctggcggcggaggtggagaccggccgccgtggaaggaggcggagccgcctcgacccaccatcactctgccgccgcggtctggttccatggagtcccttttcaatggaggattcagccctggtcccatgactctgctttctagcttttggggtgatggggatgatggaaagtccttctctcagctcctcgctggagctatgtcttctccggtggccggagctgtcgcccccggcgtgatggactcacctggtctcttttcatcttctcaggtgtcttttggaatgacacaccagcaggccctagcacaggtctcagctcaggcttcacaagccaactccaatatgcatatccaagccgaacattcattgacacaggctcctgcagctgcttccaatacaactcaacagctgatgccacctctaacttctgactcttgggctgcaatgactgaatccattgatcattctcactcagaacaaagattgcaatcatcattgttgaatgttgataagcctgcagatgatggctacaactggaggaagtatgggcagaaacaggtcaagggtagtgagtttcctcgaagttattacaagtgcacgaatccaaactgtcctgtcaagaaaaaggtcgagcgctcgcttgagggtcatgtaactgcaattatttataaaggagaacacaaccatcaatgtcctcatcctaacaagtgctcaaaagacaccatgacttcaaatgaaaattcaaatatgcaagggaatgtagattcaacgtatcaagggacgagtacaaactcaatgtctaagatggatcccgagtcaagtcaggcaacagctgatcgtctatcaggaacaagtgacagcgaggaagtagctgatcatgaaactgaagtggatgagaaaaatgttgagcctgagcccaagaggagaaaagcagaagtctcgcagtcagatccaccttcttcacataggactgtcaccgagcctcgaatcattgtgcaaacaacaagtgaagttgatctcttagatgatgggtatagatggcgaaaatatgggcagaaagttgtcaaaggcaacccttatcctaggagctattacaaatgtacaacgcaaggttgcaatgtgcggaagcatgtggagagggcttcaacagaccctaaagctgtcataacgacatatgaaggaaaacacaatcatgatgtgccagcagctaagactaacagccacactatggccagcaatactgcatcacagttaaaatcacataacaccaatcccgagaagcataattttggcagcagaggtatgggaggaaatgaacaacagccggtcgcacggcttcagttgaaggaagagcagatcacc

SEQ ID NO: 1162 - protein, 455 aa, Glycine max
  Glyma02g12490.1 polypeptide
MAGGGGGDRPPWKEAEPPRPTITLPPRSGSMESLFNGGFSPGPMTLLSSFWGDGDDGKSFSQLLAGAMSSPVAGAVAPGVMDSPGLFSSSQVSFGMTHQQALAQVSAQASQANSNMHIQAEHSLTQAPAAASNTTQQLMPPLTSDSWAAMTESIDHSHSEQRLQSSLLNVDKPADDGYNWRKYGQKQVKGSEFPRSYYKCTNPNCPVKKKVERSLEGHVTAIIYKGEHNHQCPHPNKCSKDTMTSNENSNMQGNVDSTYQGTSTNSMSKMDPESSQATADRLSGTSDSEEVADHETEVDEKNVEPEPKRRKAEVSQSDPPSSHRTVTEPRIIVQTTSEVDLLDDGYRWRKYGQKVVKGNPYPRSYYKCTTQGCNVRKHVERASTDPKAVITTYEGKHNHDVPAAKTNSHTMASNTASQLKSHNTNPEKHNFGSRGMGGNEQQPVARLQLKEEQIT

SEQ ID NO: 1163 - DNA, 1017 bp, Glycine max
  Glyma07g35380.1
atgacacaccagcagatgctagcacagatcacatctcaggctgtgccagcccacttcaatgtgcaaattcactctgaacatccattctctatatcagcagtgtctgctacctctttgacacagtttcctacaggatccagtactagggtgaaagaatcccttcattattctcactctgaacaaaaattgcagtcttcttctgtgaatgctgataagcctaatgatgatggctacaattggaggaagtatgggcaaaaacatgtgaaaggtagagacttctcaagaagttattacaaatgcacacatccaaattgtcctgtcaagaaaaaacttgagcgttctcttgaaggtcatgtgactgcaattatctataaaggagagcacaatcatcaacgtcctcatcccaataagatcacgaaagaaacacagacttcgaatataaattcagtgtctaagatggatctagaatctagtcaggcaacaggtgaacatgggtcaggaacaagtgatagtgaggaagtaggtgatcatgaaagtgaagaagatgagaaaaatgatgaacctgatgccaagagaagaaacacagaagtcaggctccaggatccagcctctttacatagaactgtagcagagactagaatcattgtgcaaacaacaagtgaagtggatctcttagatgatggatatcgatggcgcaaatatgggcagaaagttgtcaaaggcaacccatatccaaggagctattacaaatgtgcaacccaaggttgcaatgttcggaagcatgttgagagggcttcaatggatcctaaagctgtcctaacaacatacgaaggaaaacacaatcatgatgtgccggtagctaagactaatagccacacacttgccaacaatagtgcatcacagctaaaagcacaaaatattgccatacccgacgacaagcatagtttcagcagtaggggtgttcgggggaatgaacagcgacctttgggaagtctaagattgaaggaagagcagata

SEQ ID NO: 1164 - protein, 340 aa, Glycine max
  Glyma07g35380.1 polypeptide
MTHQQMLAQITSQAVPAHFNVQIHSEHPFSISAVSATSLTQFPTGSSTRVKESLHYSHSEQKLQSSSVNADKPNDDGYNWRKYGQKHVKGRDFSRSYYKCTHPNCPVKKKLERSLEGHVTAIIYKGEHNHQRPHPNKITKETQTSNINSVSKMDLESSQATGEHGSGTSDSEEVGDHESEEDEKNDEPDAKRRNTEVRLQDPASLHRTVAETRIIVQTTSEVDLLDDGYRWRKYGQKVVKGNPYPRSYYKCATQGCNVRKHVERASMDPKAVLTTYEGKHNHDVPVAKTNSHTLANNSASQLKAQNIAIPDDKHSFSSRGVRGNEQRPLGSLRLKEEQIT

SEQ ID NO: 1165 - DNA, 1317 bp, Glycine max
  Glyma20g03410.1
atggttgacggcggaaaaggagagggaggaggagagcaagcatcgccaccctcgacggcggcgcgtcacggaaccactctccggccacgcgcctccgtggagagtgttttcagcggcgggtatagccccggtcccatggctctgctttccaatttctacggcgacggcgatgagtgcaagtcgttctcggagctcctcgccggcgccatggtggaccccacggcaccctcgcccatgcccaccacaacgttcgcgcttccacctggattcatcgattcaccttctcaaggccaatttggaataacacaccagcagatgctagcacagatctcatctcaagctgtgcaaacccactctgaacatccattctctatatcagccgtatctgctacctcatcatgtgctgcacaacagctgattccaccctcaatgccagattctaaggtgaaagaatcccttgattattctcactctgaacaaaaattgcagtcttctgtgaatgttgataataagcctaataatgatggttacaactggaggaagtatgggcaaaaacatgtgaaaggtagtgacttctcaagaagttattataagtgcacacgtccaaattgtcctgtgaagaaaaaacttgagcgttctcttgagggtcatgtgactgcaattatttataaaggagaacacaatcatcaacgtcctcatcgcagtaagattgtgaaagaaacacaaacttcaaatgaaaattcagtgtctaagatggatctagggtctagtcaggccacaggtgaacatggatcaggaacaagtgatagtgaggaagtagatgaccatgaaactgaagcagatgagaaaaatgatgaacctgatgccaagagaagaaacacagaagccaggatccaggatccagccactttgcatagatctgttgcagagcctagaatcattgtgcaaacaacaagtgaagtgaatctcttagatgatggatatcgatggcgcaaatatgggcagaaagttgtcaaaggcaacccatatccaaggagctattacaaatgcacgacccaaggttgcaaagttcggaagcatgttgagagggcttcaatggatcctaaagctgtcataacaacatacgaaggaaaacacaatcatgatgtgcctgcagctaagactaatagccacacacttgccaacaatagtgcatcccagctaaaagcacaaaagtttgccatacccgacgtgaaacatagttccagcagcaggggtgttactggcaatgagcagcgacctgtggcaagtctaagattgaaggaagagcagatcaca

SEQ ID NO: 1166 - protein, 439 aa, Glycine max
  Glyma20g03410.1 polypeptide
MVDGGKGEGGGEQASPPSTAARHGTTLRPRASVESVFSGGYSPGPMALLSNFYGDGDECKSFSELLAGAMVDPTAPSPMPTTTFALPPGFIDSPSQGQFGITHQQMLAQISSQAVQTHSEHPFSISAVSATSSCAAQQLIPPSMPDSKVKESLDYSHSEQKLQSSVNVDNKPNNDGYNWRKYGQKHVKGSDFSRSYYKCTRPNCPVKKKLERSLEGHVTAIIYKGEHNHQRPHRSKIVKETQTSNENSVSKMDLGSSQATGEHGSGTSDSEEVDDHETEADEKNDEPDAKRRNTEARIQDPATLHRSVAEPRIIVQTTSEVNLLDDGYRWRKYGQKVVKGNPYPRSYYKCTTQGCKVRKHVERASMDPKAVITTYEGKHNHDVPAAKTNSHTLANNSASQLKAQKFAIPDVKHSSSSRGVTGNEQRPVASLRLKEEQIT

SEQ ID NO: 1167 - DNA, 1569 bp, Glycine max
  Glyma08g26230.1
atgtccactcccaacaccgattccggcacggcgccgccaccgcgccccaccatcacgctccctccgcgcccctccgccgaggccttcttctccgccgccgccggcgccagccccggccccatgaccctcgtctccagcttcttcggctccgacgccgccgccgactgccgctccttctctcagctcctcgctggtgccatggcctccccgatggccttctccgccgctgccgcagccgccgacaactccggcaaggacgacgatgggccccacaaggggttcaagcagagcagacccatgaatttggtcattgctcgttcccctgtcttcactgtgccacccgggttgagcccttctgggtttcttaactcccctggcttcttttcccctcagagcccctttgggatgtcccaccaacaggctttagcgcaggttacagctcaagctgtcctagctcaatcccatatgcacatgcaagctgattatcagatgcctgcggtaacagctccaaccgaaccacctgtacggcagctgtcttttgctctaaatgaagcttcggagcagcaagtggtatcatgtgtatcatctgtatcagaacctagaaatgctcaactcgaagcaccggaactctcacaggctgataagaaatatcaaccatcatcccaggccattgacaaacctgcagatgatggctacaactggcgtaagtatgggcagaagcaggttaagggtagtgagtatccacgaagctattacaagtgcacacatctgaattgtgttgtgaagaaaaaagttgagcgtgcccctgatggtcacataactgaaattatctataaaggccagcataaccatgaaaagcctcaggcaaataggcgtgccaaagataatagtgattcaaatggaaatgtaactgttcagcccaaatctgagtcaaactcacaaggttgggttggacaattaaacaagtttagtgaaaaaattcctgattcttcagttgctaaaagtgaccagacctccaatcaaggggctcctcctaggcaactactacctgggtcaagtgagagtgaggaagtgggtgatgtagataatagggaagaggcagatgatggcgagccaaaccctaagagaaggaatactgatgttggggtttctgaagtacctctgtctcagaagactgtcacagaacccaaaatcatcgtgcaaacaagaagtgaagttgatcttttggatgatggctacaggtggcgaaaatatggtcagaaagtggtaaagggaaaccctcatccaaggagttattacaaatgcactagtgcaggatgcaacgtgcgcaagcatgttgagagagcttcaatggaccccaaagctgtcataaccacgtatgagggtaaacataatcatgatgtgcctgctgctagaaacagcagccacaacacagctagtagcaattcaatgccattaaaaccacataatgtggtgccggagaaacatcctttgctcaaggatatggattttggaagtactgaccaaagacctgtacatttgcgtttgaaagaagagcaaatcatagta

SEQ ID NO: 1168 - protein, 523 aa, Glycine max
  Glyma08g26230.1 polypeptide
MSTPNTDSGTAPPPRPTITLPPRPSAEAFFSAAAGASPGPMTLVSSFFGSDAAADCRSFSQLLAGAMASPMAFSAAAAAADNSGKDDDGPHKGFKQSRPMNLVIARSPVFTVPPGLSPSGFLNSPGFFSPQSPFGMSHQQALAQVTAQAVLAQSHMHMQADYQMPAVTAPTEPPVRQLSFALNEASEQQVVSCVSSVSEPRNAQLEAPELSQADKKYQPSSQAIDKPADDGYNWRKYGQKQVKGSEYPRSYYKCTHLNCVVKKKVERAPDGHITEIIYKGQHNHEKPQANRRAKDNSDSNGNVTVQPKSESNSQGWVGQLNKFSEKIPDSSVAKSDQTSNQGAPPRQLLPGSSESEEVGDVDNREEADDGEPNPKRRNTDVGVSEVPLSQKTVTEPKIIVQTRSEVDLLDDGYRWRKYGQKVVKGNPHPRSYYKCTSAGCNVRKHVERASMDPKAVITTYEGKHNHDVPAARNSSHNTASSNSMPLKPHNVVPEKHPLLKDMDFGSTDQRPVHLRLKEEQIIV

SEQ ID NO: 1169 - DNA, 1560 bp, Glycine max
  Glyma18g49830.1
atgtacactcccaacgccgattccggcacggcgccgcatccgcgccccaccatcacgctccctccgcgtccctccgccgaggccttcttctctgccgccggcggcgccagccccggccccatgaccctcgtctccagcttcttcggctccgatgccgctgccgactgccgctccttctcgcagctcctcgccggcgctatggcctccccaatggccttctccgccgccgcagcatccgccgccgacaactccggcaaggacgacgatgggccccacaaggggttcaagcagagcagacccatgaatttggtcattgctcgttcccctgtcttcactgtcccacctgggttgagcccttctgggtttcttaactcccctggcttcttttcccctcagggcccctttgggatgtcccaccaacaggctttagcacaggttacagctcaagctgtcctagctcaatctcatatgcatatgcaagctgattaccagatgccttcagtaacagctcccactgaaccacctgtacagcagctgtcttttgctctaaatgaagcttcagagcagcaagtggtatcatgtgtatcagaacctagaaatgctcaacttgaagcaccggaactctcacaggctgataagaaatatcaaccatcttcccaggccattgacaaacctgcagatgatggctacaactggcgtaagtatgggcagaagcaggttaagggtagtgagtatccacgaagctattacaagtgcacacatctgaattgcgtcgtgaagaaaaaagttgagcgtgctcctgatggtcacataactgaaattatctataaaggccagcataatcatgaaaagcctcaggcaaataggcgtgccaaagataatagtgattcaaatggaaatgtaactgttcagcccaaatctgagtcaaactcacaaggttgggttggacaattaaacaagttaagtgaaaacattcctaattcttcagttcctgaaagtgaccagacctccaatcaaggggctcctaggcaacttctacctgggtcaaatgagagtgaggaagtgggtattgtagataatagggaagaggcagatgatggcgagccaaaccctaagagaaggaatactgatgttggagtttctgaagtacctctgtctcagaagactgtcacagaacccaaaatcattgtgcaaacaagaagtgaagttgatcttttggatgatggctacaggtggcgaaagtatggccagaaagtggtgaagggaaaccctcatccaaggagttattacaaatgcactagtgctggatgcaacgtgcgtaagcatgttgagagagcttcgacggaccccaaagctgtcataaccacgtatgagggtaaacataatcatgatgtacctgctgctagaaacagcagccacaacacagctagtagcaattcaatgccattaaaaccgcataatgtcgtgccagagaagcatcctttgcttaaagataaggattttggaggtaatgaccaaagacctgtacatttgcgcttaaaagaagagcaaattatagta

SEQ ID NO: 1170 - protein, 520 aa, Glycine max
  Glyma18g49830.1 polypeptide
MYTPNADSGTAPHPRPTITLPPRPSAEAFFSAAGGASPGPMTLVSSFFGSDAAADCRSFSQLLAGAMASPMAFSAAAASAADNSGKDDDGPHKGFKQSRPMNLVIARSPVFTVPPGLSPSGFLNSPGFFSPQGPFGMSHQQALAQVTAQAVLAQSHMHMQADYQMPSVTAPTEPPVQQLSFALNEASEQQVVSCVSEPRNAQLEAPELSQADKKYQPSSQAIDKPADDGYNWRKYGQKQVKGSEYPRSYYKCTHLNCVVKKKVERAPDGHITEIIYKGQHNHEKPQANRRAKDNSDSNGNVTVQPKSESNSQGWVGQLNKLSENIPNSSVPESDQTSNQGAPRQLLPGSNESEEVGIVDNREEADDGEPNPKRRNTDVGVSEVPLSQKTVTEPKIIVQTRSEVDLLDDGYRWRKYGQKVVKGNPHPRSYYKCTSAGCNVRKHVERASTDPKAVITTYEGKHNHDVPAARNSSHNTASSNSMPLKPHNVVPEKHPLLKDKDFGGNDQRPVHLRLKEEQIIV

SEQ ID NO: 1171 - DNA, 1305 bp, Vitis vinifera
  GSVIVT01001332001
atgactaaaaacgatgaaacgtcactatcatcatcggcatcagcatcgagagcttctgctcctctacggcctactataacgctgccccctcgttcctccatggaaactctctttcctggaggtcccggcttcagtcccggtcccatgactctcgtctctaattttttctccgacaacgaccccgactccgactgccgctccttctctcagctgctcgccggcgctatggcctcgcccgcagcttttcccggccccaggcccagtttttccaccgaccctcaggtctccgcttcttccaaggaagacaggacttccgttgatgccgctggtgattttgaatttcggttcaagcagaaccggccctccggtttggtgattgctcagtccccgttgtttacagttcctcccgggttaagcccgacctgtttgctcgattccccaggtttcttttcgcagggaccatttgtaatgtcccatcagcaggccttagctcaggttaccgctcaggctgcacaagcccattcccatatgcaactccaagccaaatttccgtcttctttatcacagatgccacccttagtatcagatactagaactgctgtgaaggaatcatctggtttatctcaatctgatcagagatcccaaccttcttcatttacagttgataagcctgctgatgatggctacaattggcggaaatatgggcagaagcaagtgaagggaagtgaatatcctcgaagctattacaaatgtacacatccaagttgtcctgttaaaaaaaaggttgaacgttctcttgatggccaagtaacagagattatttataagggccagcacaaccatcaagcaccactacccaacaagcaatctagtcaagccatacctgaacacttacctggatcaagtgacagtgaggaaatggatgatgctgagactagaggtgatgaaaagggtgaagatgaacctgaccccaaaagaaggaatacagaggtcagggtttcagatcaggtttcctcccatagaacagtcacagaacctaggattattgtgcagacaaccagtgaagttgatctcttggatgatggctataggtggcgcaagtatgggcagaaagttgtcaaaggaaatccttatccaaggagctactataaatgcacaaatccaggatgcaatgtccgtaagcatgttgagagggcagcaacagacccgaaagccgtcataacaacatatgaaggtaaacataatcatgatgtgccagcagctaaaagtagtagccacaacacagccaacagcattgcatcacaa

SEQ ID NO: 1172 - protein, 435 aa, Vitis vinifera
  GSVIVT01001332001 polypeptide
MTKNDETSLSSSASASRASAPLRPTITLPPRSSMETLFPGGPGFSPGPMTLVSNFFSDNDPDSDCRSFSQLLAGAMASPAAFPGPRPSFSTDPQVSASSKEDRTSVDAAGDFEFRFKQNRPSGLVIAQSPLFTVPPGLSPTCLLDSPGFFSQGPFVMSHQQALAQVTAQAAQAHSHMQLQAKFPSSLSQMPPLVSDTRTAVKESSGLSQSDQRSQPSSFTVDKPADDGYNWRKYGQKQVKGSEYPRSYYKCTHPSCPVKKKVERSLDGQVTEIIYKGQHNHQAPLPNKQSSQAIPEHLPGSSDSEEMDDAETRGDEKGEDEPDPKRRNTEVRVSDQVSSHRTVTEPRIIVQTTSEVDLLDDGYRWRKYGQKVVKGNPYPRSYYKCTNPGCNVRKHVERAATDPKAVITTYEGKHNHDVPAAKSSSHNTANSIASQ

SEQ ID NO: 1173 - DNA, 1524 bp, Solanum lycopersicum
  Solyc05g012770.2.1
atggccgaaaatgaaggatcatcttcttcttcaacgtcgagaggtcaattactccgtccaactattactttaccgccgagaagttctatggaaagtctattttcaggcgggtcaagcggtattagtccgggtccgatgacccttgtatccagttttttctccgataacgatccagattctgagtgtcgttcattttcacagcttctagccggtgcaatgacacctccggcgggttttaccggtgttagaccgggtttcccgccacttccgccaccatctacggcggcgataactcagtcgccgactgcgtttactgtaccgcctgggttgagtccaactagtttgtttgatgggttcttctcacctggtcagggtccttttggaatgtcacatcagcaagtgcttgctcaacttacatctcaggcatcccaggctcagtctcaaatgcacattcagcctaactatccatcttctgcaacggcagctgcactatcaatgtctcagttccagtccttaccatcaaatgcagcagcaaaccgacagatacctcccactttggatcccaacatcgtgaaagagtcatcagatgtttccctgtctgatcagaggtcagaacctgcttcctttgctgttgacaaacctgctgatgatggctacaactggcgaaagtatgggcagaagcaggtcaagggaagtgaatatcctcgtagctattacaagtgtacaaatccaaattgtccagtcaagaagaaggttgagcgctccctagatggccaggttactgagattatttacaagggccaacataatcatcagccacctcaagctagtaagcgttcaaaagaaagtggaaatccaaatgggaactataatctgcaggggccctatgagctcagctcagagggtctgacaggaaactataacaaacccaaggagggcgaaccttcctactcgttaagaatgaaggatcaagaatccagccaagcaaatgatcagacctctggctcaagtgacagtgaggaagtgggtaatgcagagactagagtggatggaagggacattgacgaacgggaatcaaagcggagggctgtagaagtacacagtacagaggcagcttgttctcaccggactgttgcagaacctaggatcattgttcaaacaaccagtgaagttgatctattggatgatggttataggtggcggaagtatggccagaaggttgttaaaggaaacccttatccaagaagctattacaagtgtaccagccagggatgtaatgtaagaaagcatgttgaacgggctgcaagtgaccctaaagcagtcataacaacatacgaaggtaaacataatcatgatgtgcctgcagccaggaatagtagccacaatacagccaataattctatgtcacaattgaggccacacaaccctgtagttgatagaccagctgcaatgcgaagagcggactttcagagcaatgaacaacaacctatagcgcttctacgtttcaaagaagagcaaagtata

SEQ ID NO: 1174 - protein, 508 aa, Solanum lycopersicum
  Solyc05g012770.2.1 polypeptide
MAENEGSSSSSTSRGQLLRPTITLPPRSSMESLFSGGSSGISPGPMTLVSSFFSDNDPDSECRSFSQLLAGAMTPPAGFTGVRPGFPPLPPPSTAAITQSPTAFTVPPGLSPTSLFDGFFSPGQGPFGMSHQQVLAQLTSQASQAQSQMHIQPNYPSSATAAALSMSQFQSLPSNAAANRQIPPTLDPNIVKESSDVSLSDQRSEPASFAVDKPADDGYNWRKYGQKQVKGSEYPRSYYKCTNPNCPVKKKVERSLDGQVTEIIYKGQHNHQPPQASKRSKESGNPNGNYNLQGPYELSSEGLTGNYNKPKEGEPSYSLRMKDQESSQANDQTSGSSDSEEVGNAETRVDGRDIDERESKRRAVEVHSTEAACSHRTVAEPRIIVQTTSEVDLLDDGYRWRKYGQKVVKGNPYPRSYYKCTSQGCNVRKHVERAASDPKAVITTYEGKHNHDVPAARNSSHNTANNSMSQLRPHNPVVDRPAAMRRADFQSNEQQPIALLRFKEEQSI

SEQ ID NO: 1175 - DNA, 1380 bp, Solanum lycopersicum
  Solyc02g088340.2.1
atgggggaaacaggggaagcttcagcaatatcgtttccatctttgacaattccacctcgcccttcatttgaatccttttttaacatgtcttctttcagcccaggtccaatgtctcttgtttccagtttcttgtctgatcagagccctgattctgcagattgtcctccttctttctcccagcttctcgccggatatgaatattctggagatcctcctgggtgtcaaaagaactctgggtataaccaaaatgggtctgtgaatcctcaattgttcgttattccctctggtttgagtccttctggattccttaattctcctggctttctttccccacttcagagtccctttggaatgtcacatcagcaggctctagcacatgttacagcacaggctgaattttctagttcatatatgcaaatgcaaatgcaaatgcaagcccaagaccagtgttcctctcaggtggctccagtagaagcattaggacatgagttgtcgattgatccaaaggagtcttccttgcagataaaggaatgtctgcaatctagtttggataacaagccatcagacaatcagggtaagcaatttgaacagccggaggtttctcaatctgagaacaagacatcctctggtgctctcgataagccagcttgtgatggttataactggagaaaatatggtcagaaaaaggttaaagctagtgaatgccctaggagctactataagtgcacatatctcaaatgtctagtgaagaagaaggttgagcggtctgttgatggtcacataactgagatcacatataatggccgtcacaaccatgatcaaccaaccaaacgaagaaaaaatggttctgctttggataatacagactgctttggagttcgaccagatattagtacacatgattggacagtaatgaatagctcggatgggtcttctccttctcgatctgaccaggttccaacccaaatggtatctgaacttcttgtgaaaagagaatgtgatgaaaccgaaagctatttgatagacgtagatgatgaagggcatgatgaaccagatgcaaagagaacgaagacggcaattgagactgtagcttcatcacatgtcacagtagctgaatccaagattgttctgcagacgagaagtgaagttgatttcttagatgatggatataaatggcgaaaatatgggcagaaggtggtaaaggggactcagcatccaaggagttactatcggtgcacatatcctggatgcaatgtccgcaaacaagtcgagagggcttcaactgatccaaaagctgtcataacaacatatgaaggcaagcataatcatgatattcctactgttagtgttaggaatagaggaacaaggaataaatacagc

SEQ ID NO: 1176 - protein, 460 aa, Solanum lycopersicum
  Solyc02g088340.2.1 polypeptide
MGETGEASAISFPSLTIPPRPSFESFFNMSSFSPGPMSLVSSFLSDQSPDSADCPPSFSQLLAGYEYSGDPPGCQKNSGYNQNGSVNPQLFVIPSGLSPSGFLNSPGFLSPLQSPFGMSHQQALAHVTAQAEFSSSYMQMQMQMQAQDQCSSQVAPVEALGHELSIDPKESSLQIKECLQSSLDNKPSDNQGKQFEQPEVSQSENKTSSGALDKPACDGYNWRKYGQKKVKASECPRSYYKCTYLKCLVKKKVERSVDGHITEITYNGRHNHDQPTKRRKNGSALDNTDCFGVRPDISTHDWTVMNSSDGSSPSRSDQVPTQMVSELLVKRECDETESYLIDVDDEGHDEPDAKRTKTAIETVASSHVTVAESKIVLQTRSEVDFLDDGYKWRKYGQKVVKGTQHPRSYYRCTYPGCNVRKQVERASTDPKAVITTYEGKHNHDIPTVSVRNRGTRNKYS

SEQ ID NO: 1177 - DNA, 1458 bp, Solanum lycopersicum
  Solyc03g104810.2.1
atgggggaaaacttcaaagctccatcagtttcagtgtcttcactttcaacactaacaatcccacctaaagactcattttttggtggtggaaatatgccctattttagtccaggtccaatgacccttgtctctactttcttctctgaatctgagtacccatctttctcccagcttcttgctggagctatggcttctccattagcaaaaccgcctaccctttttcctggagaagaagagaattgtaaacaagggtataaacagaatcgacccatgaatctaatggtggctcaatctcctttcttcaccattccaaccgcttttactccttctggattgcttaattcacctggatttctttccgcagttcagagtccttttggaatgtcacaccagcaggccctagcacatgttacagcacaggcagcgttatcccagtcttacttacaaactcaagctgaatgccatttcccctcgcaaagtaaatcagtacaagtattaggggcatctgacccagaggagtcttctttacaacctcaattagatactatgtcgtcagaccagaagagtaagaaatttgaactgccacagctttcgcaatctgaggacaaaccatcctttaattcagtcgatagaccagcttctgatggttacaattggaggaagtatggccagaagatggttaaagcaagtgaatgccctcggagctactataaatgcacacatctcaaatgtcttgtcaagaagaaggttgagcgatccattgatggtcacataactgagataacctataaaggccatcacaaccatgaacttcctcaacccaacaaacgcagaagagacagttgtgctcaggatggttcagactgctccaatattaaccctgaaactggaacacatactgagctagaaatcaacggcttaaatggggctcttgttgctcattctgaacaggtgtctactgaaatggcgtgtgaacgttctgtttcgaatgaatgtgaggatgctgaaacagcagcaagcaaggaacatgatgatgaaccaaatgtgaagagaatgaagacaacagttgagactcctattctttcatcatcacataaagcagaaccagaatccaagattgttgtgcagacaaggagtgaagtagacattttggatgacgggttcaagtggcgtaaatatggacagaaaatggtgaaagggaatcatcatccaaggagttattatcgttgcacataccctggatgcaatgttcgtaaacatgttgagagagcttcagcagatccaaaagctgtcataacaacatatgagggcaagcacaatcatgatattcccattgctagaaacagaagccatagcacagcccaaaatagtagtcgtcagttgaatgagcaagagattgcaacttggaggcctgctattctcgaaaaagttgctcttcataccagtgaaatacaagtg

SEQ ID NO: 1178 - protein, 486 aa, Solanum lycopersicum
  Solyc03g104810.2.1 polypeptide
MGENFKAPSVSVSSLSTLTIPPKDSFFGGGNMPYFSPGPMTLVSTFFSESEYPSFSQLLAGAMASPLAKPPTLFPGEEENCKQGYKQNRPMNLMVAQSPFFTIPTAFTPSGLLNSPGFLSAVQSPFGMSHQQALAHVTAQAALSQSYLQTQAECHFPSQSKSVQVLGASDPEESSLQPQLDTMSSDQKSKKFELPQLSQSEDKPSFNSVDRPASDGYNWRKYGQKMVKASECPRSYYKCTHLKCLVKKKVERSIDGHITEITYKGHHNHELPQPNKRRRDSCAQDGSDCSNINPETGTHTELEINGLNGALVAHSEQVSTEMACERSVSNECEDAETAASKEHDDEPNVKRMKTTVETPILSSSHKAEPESKIVVQTRSEVDILDDGFKWRKYGQKMVKGNHHPRSYYRCTYPGCNVRKHVERASADPKAVITTYEGKHNHDIPIARNRSHSTAQNSSRQLNEQEIATWRPAILEKVALHTSEIQV

SEQ ID NO: 1179 - DNA, 1587 bp, Eucalyptus grandis
  Eucgr.B03189.1
atggccacggacgaaaaaccgccgcagcagcagccgccgccgccgccgccgtcgtcggcgtcagcgtcgtcggcgaagcctcccgcgcggcccaccatcactctccccccgcgcgcctccatcgactccttcttctccaacggccccgcggccgcctccgccggggggctcggcctcagcctcggcttcagccccggcccgatgaccctcgtctccagcttcttctccgactccgaagagtacaagtccttctcccagctcctcgccggcgccatggcctctcccgcagctcaacgcccgccccccgccgccggggagcccgctcccgctcccccggacgcggccggcgagggggagttccggttcaagcagaaccggcccgagggtttggtaatttcgccgccgcctcccctgtcgccgctcttcgcggtgcctcccgggcttagccccaccacgttgctcgactcgccggggtttttctcgccggggccttttgggatgtcacatcaacaagccctggcacaggttactgctcaggctgcacaagcccagtcctatttgcagatgcactttgaatattcaaactcagcatctgcagcgcctgcaacgtctctggcacagccaatcttccagcaggtgccatctttaccagatgagaaagttgcagtgactgaatcgtctgagctatctcagtctgatctgagagcacaacctcccttgcaagtagataaaccagctgatgatgggtacaattggagaaaatatgggcagaaacaggttaagggtagtgaattcccaaggagttactacaaatgcacacatcctgactgccctgtcaggaaaaaggttgagcgttctcttgacggccatataacagaaataatctataagggacagcacaaccatcaacgtcctctaaataagcgcgcaaaagatgctggaactgctggtggtggtgattcgcatgttcaggagcatccgcaatttatgtcacatgttcagagtggtgaaccttctaatttaatgtttaaaaaggagcaggaatctagccaattaactcctgagcatttgtccggtacaagtgacagtgaagaagttggaaattctgagtatggagcagaggaaggatgtgaaggtgaacctgaacccaaaagacgcaacacagaaattagggttgtggagtctgctgcttcactcaaggctgtaagtgaacccaaaataatcgtgcaaacaaccagtgaagttgatcttctggacgatggctacagatggcggaaatatgggcagaaagtagtcaaagggaatccttatccaaggagctattacaagtgcacaactcctggatgcaatgttcgtaaacatgtagagagggcttcaactgaccccaaagctgtcattacgacgtatgagggtaaacacaatcatgatgtaccggctgccagaaccagcagccacagtattgccaactctaacataccacaggttaggccacatcaaacacaagacaataggcgcacctcaagtggcaaaacagattttgtgaataggccgatagcacgcctacttttgaaagaagagcagacaaca

SEQ ID NO: 1180 - protein, 529 aa, Eucalyptus grandis
  Eucgr.B03189.1 polypeptide
MATDEKPPQQQPPPPPPSSASASSAKPPARPTITLPPRASIDSFFSNGPAAASAGGLGLSLGFSPGPMTLVSSFFSDSEEYKSFSQLLAGAMASPAAQRPPPAAGEPAPAPPDAAGEGEFRFKQNRPEGLVISPPPPLSPLFAVPPGLSPTTLLDSPGFFSPGPFGMSHQQALAQVTAQAAQAQSYLQMHFEYSNSASAAPATSLAQPIFQQVPSLPDEKVAVTESSELSQSDLRAQPPLQVDKPADDGYNWRKYGQKQVKGSEFPRSYYKCTHPDCPVRKKVERSLDGHITEIIYKGQHNHQRPLNKRAKDAGTAGGGDSHVQEHPQFMSHVQSGEPSNLMFKKEQESSQLTPEHLSGTSDSEEVGNSEYGAEEGCEGEPEPKRRNTEIRVVESAASLKAVSEPKIIVQTTSEVDLLDDGYRWRKYGQKVVKGNPYPRSYYKCTTPGCNVRKHVERASTDPKAVITTYEGKHNHDVPAARTSSHSIANSNIPQVRPHQTQDNRRTSSGKTDFVNRPIARLLLKEEQTT

SEQ ID NO: 1181 - DNA, 1566 bp, Eucalyptus grandis
  Eucgr.G02469.1
atggcattcgccaatcacgtcccgctttgggcgcacgctctcgggatatttccgtcttctcgagaattgtttagtatttcgcagtttgattctggaaactccagcggcggcggcggcggcggtggtggcgggggctggctgggcgggatgggcttgggactcagcccgggccccatgaccatggtctcccacctcttccccgatggcgaggactgcaagtccttctctcagctcctctcgggcgccaccgcggcttctcccacggctcagtatctcggcttctccttcccctcggccagcagcgcgcccgagaggaccgccgtcctgcccccaggagaattgcgtttcaagcagagccgtccggatggattggcggtcacgcagccgctgttcgccataccaccggggctgagcccgggggctttgctcgactcccccgggaccttccatcctgttccggggcatctaggaatgtcataccaacacggcttcctccgcatgggcactcaaggtttgcaagctcagcctcatcacgtccaatccgggtatgcatcggcatcttcctcgaccgctgcactatccttaggaaggatgcagtttccgccctttgcagtgagcacgtcgatgatgaaccagcagaacctgtccttggaaggaccgaaaattatcgagtcagaacccatcgacttctctcgccccgatcagagacctcccgtgtcttcatttgccattgataagcctgccgatgatggctacaattggaggaagtatggtcagaaacaggtcaagggaagcgaattccctcggagctattacaagtgcacgcaccctacctgtcccgtcaagaagaaggtcgagcgctctctggatggccagataaccgagataatctacaagggacagcacaatcatcagccccccaagggcaataagcgcgcgaaggactctggagctgccaatgggagttcagacgttgaggaaagttctcagattccccttggattgatgcctcaggatccggaatctagccaggtcacacctgcacagttctccgggaccagtgacagtgaggaagttggcgatgctgatactggagccgatgaaggagatgaggatgaacctgaaccaaagcgacgaagcatggaggtaatggctccggatgcaggatctgtgcataggaccatcacagaaccgaagataatcgtgcaaacgacgagtgaagtcgatcttttggatgacggctataggtggcgcaagtatgggcagaaacttgtcaaaggcaacccttatccaaggagctactacaaatgcacaactacaggatgcaatgtccggaagcatgtcgagagggcttcaagcgaccctaaagctgtcataacgacatacgaaggcaaacacaatcacgatgttccggctgctaaaccgagcagccacagtgtcgccaacagctacgcctcacagtcaagacagcaacagaatgcagaactggagaagcatgccatgttcagaaccagtgcgcaacagcagctgacgtcccgtttacgtctaaaggaagaacagctaacc

SEQ ID NO: 1182 - protein, 522 aa, Eucalyptus grandis
  Eucgr.G02469.1 polypeptide
MAFANHVPLWAHALGIFPSSRELFSISQFDSGNSSGGGGGGGGGGWLGGMGLGLSPGPMTMVSHLFPDGEDCKSFSQLLSGATAASPTAQYLGFSFPSASSAPERTAVLPPGELRFKQSRPDGLAVTQPLFAIPPGLSPGALLDSPGTFHPVPGHLGMSYQHGFLRMGTQGLQAQPHHVQSGYASASSSTAALSLGRMQFPPFAVSTSMMNQQNLSLEGPKIIESEPIDFSRPDQRPPVSSFAIDKPADDGYNWRKYGQKQVKGSEFPRSYYKCTHPTCPVKKKVERSLDGQITEIIYKGQHNHQPPKGNKRAKDSGAANGSSDVEESSQIPLGLMPQDPESSQVTPAQFSGTSDSEEVGDADTGADEGDEDEPEPKRRSMEVMAPDAGSVHRTITEPKIIVQTTSEVDLLDDGYRWRKYGQKLVKGNPYPRSYYKCTTTGCNVRKHVERASSDPKAVITTYEGKHNHDVPAAKPSSHSVANSYASQSRQQQNAELEKHAMFRTSAQQQLTSRLRLKEEQLT

SEQ ID NO: 1183 - DNA, 1695 bp, Eucalyptus grandis
  Eucgr.I01998.1
atgaatacactatttatcaaaaatcttatttatgttttcttggcatcctttgatgaagtgaaacagcaaaaaaagaaccattacaaaaaggtgggacttttaactgaacttcttctggagagcgaagacaagaagaggctaggacaggacggcaagtggcggtggagcgcaaagacaacaccagcacccgtcgatactgggctttcccagaggagaaaaaaactaagccaagatatggccggaaagcagccgccgccgccgctgcggcccaccatatcggtgccgccgcgcccgccggcggccgccatgttcgggccctgcgcgagccccggcccgttgacgctggtctccagcttcttcgccgagtccgacggcgggtccttctcggagctgctcgccggggccatgtactccccgctcgccgtcaacgccgcgggcccaagctcgttcctttgggactacccgcgcgagaacccgtcgagggaaggggagcctcgagatgggcaggcgggcctgccggtgggtgctgtcaagtcgccgttgttcacggtcccccctggcttgagcccttccgggttgcttctgtcgcccggcttcttctctcctaagagcccctttgggatgtcccaccagcaggccttagcacaagtgactgctcaagctcatgttgcactagcacggtctcatgagcactcgcaattagaaattaatcctccatcagaagcatcaaaagagccactcccagatgaaccatctcttatgccaaatgaggattcacatcagctctctccatcagaagctaccacttccatggccgaatcctctgatttcgttagttccagtcacaaatgggaagctcttcccatggttctagagaagcccactgaagatgggtataattggaggaagtatggccagaagcaggtcaagggctgtggttttcccaggagctactataaatgtagccatctcaattgctcagtcaagaaaaaggttgagcattctcttgatggtcgtataacggaaattacttacagagggcaacaccagcatgaaatgcctcaagccaaaaggacttcaaaagatggtaacaacttgaacaggagcacaaattctctggctaaatctcaagctgttcttcaggggcagagtgggcgccaatctgctcctgcaatgctcaggagtggccaagatgaggagtcctctcaagcaatcgcttcaaataccagcgggttaagtaactatgtggagttagatgatgctaaatcaaagggagatggatctgatgtcgataatgatgatgttgacgctggtgatgacaaatcaaatcccaagcagaagattgtgccaattccatcaagcaaatatgtcacagaacccaagatcgttctgcagacaagaagtgaagttgatttgctggatgatggcttcaagtggcgcaaatatggacagaaagtggtcaaagggagttcctacccaaggagctactacaagtgcacttacgcaggctgcaatgtccggaaacatattgaaagggctgcgttggaccctaaatccgttataaccacttatgagggaaagcacaatcacactgcaccatctgctggaaagcgaggccgcactgttgaggcaacggaatttggcgatgcccaaagaccgtcggttctacggctgaaagaagagcaagtggctgct

SEQ ID NO: 1184 - protein, 565 aa, Eucalyptus grandis
  Eucgr.I01998.1 polypeptide
MNTLFIKNLIYVFLASFDEVKQQKKNHYKKVGLLTELLLESEDKKRLGQDGKWRWSAKTTPAPVDTGLSQRRKKLSQDMAGKQPPPPLRPTISVPPRPPAAAMFGPCASPGPLTLVSSFFAESDGGSFSELLAGAMYSPLAVNAAGPSSFLWDYPRENPSREGEPRDGQAGLPVGAVKSPLFTVPPGLSPSGLLLSPGFFSPKSPFGMSHQQALAQVTAQAHVALARSHEHSQLEINPPSEASKEPLPDEPSLMPNEDSHQLSPSEATTSMAESSDFVSSSHKWEALPMVLEKPTEDGYNWRKYGQKQVKGCGFPRSYYKCSHLNCSVKKKVEHSLDGRITEITYRGQHQHEMPQAKRTSKDGNNLNRSTNSLAKSQAVLQGQSGRQSAPAMLRSGQDEESSQAIASNTSGLSNYVELDDAKSKGDGSDVDNDDVDAGDDKSNPKQKIVPIPSSKYVTEPKIVLQTRSEVDLLDDGFKWRKYGQKVVKGSSYPRSYYKCTYAGCNVRKHIERAALDPKSVITTYEGKHNHTAPSAGKRGRTVEATEFGDAQRPSVLRLKEEQVAA

SEQ ID NO: 1185 - DNA, 1446 bp, Populus trichocarpa
  POPTR_0004s12000.1
atggcagagaaacaagaaaaccctacaacagcagccccagcaaagcctacaataactcttccaccaagaccatctatggagacccttttcacaggtggtctaagtcctggtcctatgactctagtctccagtttcttcgctgacacgccctaccctgaatctgattacccttctttctctcaacttcttgctgaagatggtattaattgcaatagcaatctgggttttaagccaagtaggcctacgaatttggtggtggctcgctctccattgtttactgtccctcctggcttgagcccttctggtttgcttgactctcctgccttcttttctcctcggagttcctttggaatgtcccatcagcaggccttggtgcaggttacagctcaagctgcattatttgcccaatctcaaatgcatatgcaagctcaatatcagccttcttcagtaacagcagctaaagagttgttgacacaatatccatcctttaaccctggtgaagctttgcaacagcagcagctgatgccaccctcaacctctgatgcgcagaattccatggtggaaccagcagagttttctcattctgaaaggaaataccaacctcctgctggtgataaacctactgatgatggttacaactggcgtaaatatggtcaaaagcctatcaaaggtagtgaatatccaagaagctactacaaatgtacacatctaaattgcctagtaaaaaagaaggttgagcgttccagtgatggccaaataactgaaatcatctacaaaggtcagcacaaccacgatcaactcaacaagctttcaaaagatggtgatgattcaaatggaagtattcattctcagtctaagcctgaagttgtttcacaagctcatgctgatccctcagagccacctggatcaagtgacaatgaggaagcaggtaatgcagctgtgcaagaagaagagaggggtgatgatgagccaatcccaaagagaaggcaagtttgggatgtttcactgcaaatagatgttgtgacatctgaggtgactttaccacacaagaccatcacagaaccaaaaatcatcgtccaaactagaagtgaagttgatcttttggatgatggctacaggtggcgcaaatatggccagaaggtggtcaaagggaatcctcatccaaggagctattacaaatgcaccagtgcaggatgcaatgttcgtaagcatgttgagagggccgcagctgatcccaaagctgtcataactacatatgagggaaagcataaccatgatgtccctgcggctagaaacagcagccataacacagccaacactaatgcagcaccattgaaacctcagaaggtggtggctgagaagcatcccatgctcaaaggaatggattttggcaacaataaccagagaccactgcttctacaactaaaagaagagaaaattgctgta

SEQ ID NO: 1186 - protein, 482 aa, Populus trichocarpa
  POPTR_0004s12000.1 polypeptide
MAEKQENPTTAAPAKPTITLPPRPSMETLFTGGLSPGPMTLVSSFFADTPYPESDYPSFSQLLAEDGINCNSNLGFKPSRPTNLVVARSPLFTVPPGLSPSGLLDSPAFFSPRSSFGMSHQQALVQVTAQAALFAQSQMHMQAQYQPSSVTAAKELLTQYPSFNPGEALQQQQLMPPSTSDAQNSMVEPAEFSHSERKYQPPAGDKPTDDGYNWRKYGQKPIKGSEYPRSYYKCTHLNCLVKKKVERSSDGQITEIIYKGQHNHDQLNKLSKDGDDSNGSIHSQSKPEVVSQAHADPSEPPGSSDNEEAGNAAVQEEERGDDEPIPKRRQVWDVSLQIDVVTSEVTLPHKTITEPKIIVQTRSEVDLLDDGYRWRKYGQKVVKGNPHPRSYYKCTSAGCNVRKHVERAAADPKAVITTYEGKHNHDVPAARNSSHNTANTNAAPLKPQKVVAEKHPMLKGMDFGNNNQRPLLLQLKEEKIAV

SEQ ID NO: 1187 - DNA, 1605 bp, Populus trichocarpa
  POPTR_0017s12430.1
atggccgagaagcaacaaaacctcacgacagcaccagcacctgcaaggcctacaataactcttccaccaagaccgtccatggagacccttttcacaggtggcttaagtcctggtcccatgactctagtctccagtttcttcgctgatagcccctaccctgaatcagattaccgttctttctcccaacttcttgctggtgctatggcttctccaattgccagccctgcttttttcaatgaccattcaatacccaacaacaatactaatactgctactgctactgctactgcaacttcttcaaaagatgatggttttaggcaaagcaggcctatgaatttggtagtggctcgctctccgttgtttactgtccctcctgggttgagcccttctggtttgcttaactctcctggcttctttcctcctcagagtcccttcggaatgtcccaccagcaggccttggcacaggttacagctcatgctgcattactcgcccaatctcaaatgcatatgcatgctcagtaccagccttcttcattaacagcaccaactgagttattgacacgccatccatcctttaaccctggtgaagctttgcaacagcagcagcagatgccacactcaacctctgacacccagaattccgtggtggaactgacagagttttctcattctgaaaggaaataccaacctcctgctgctgttgataaacctactcatgatggctacaactggagaaaatatgggcaaaagccaattaagggtagtgaatatccaagaagctactacaaatgtacacatctaaattgtccagtcaaaaagaaggttgagcgttctagtgatggccaaattaccgagatcatctacaaaggccagcacaaccacgacctgcctcaacccaacaagcgttcaaaagattgcaatgattcaaatggaagtatccatttgcaatctaagcctgaagttggttcacaagctcaagcgggcaatgcaatcaagttgactgaaacattacctgctcattcagtaattgggagggatcaggaatctactcaagcagatccctcagagccacctggacccagtgacagcgaggaagcaggtgatgcagctgtgcaagaagaagagaggggtgatgatgagccaaacccaaagagaaggcaatgcaggcaagtggatgttgtgacatctgaggcaactttacctcacaagacagtcacagaaccaaaaatcattgttcaaacgagaagtgaagttgatcttctggatgatggctacaggtggcgcaaatatggccagaaggtggtcaaagggaatcctcatccaaggagttattacaaatgcaccagtgcaggatgcaatgttcgtaagcatgttgagagggctgcagcagatcccaaagccgtcgtaactacatacgagggaaagcataaccatgatgtccctgctgctagaaacagcagccataatacagccaacactagtgcatcccaagtgaaacctcaaaaggtggtgaccgaaaagcatcccttgcacaaaggaatggagtttggcaacaatgaccaaagaccagtgcttctacagctaaaagaagaaaaaattgctgta

SEQ ID NO: 1188 - protein, 535 aa, Populus trichocarpa
  POPTR_0017s12430.1 polypeptide
MAEKQQNLTTAPAPARPTITLPPRPSMETLFTGGLSPGPMTLVSSFFADSPYPESDYRSFSQLLAGAMASPIASPAFFNDHSIPNNNTNTATATATATSSKDDGFRQSRPMNLVVARSPLFTVPPGLSPSGLLNSPGFFPPQSPFGMSHQQALAQVTAHAALLAQSQMHMHAQYQPSSLTAPTELLTRHPSFNPGEALQQQQQMPHSTSDTQNSVVELTEFSHSERKYQPPAAVDKPTHDGYNWRKYGQKPIKGSEYPRSYYKCTHLNCPVKKKVERSSDGQITEIIYKGQHNHDLPQPNKRSKDCNDSNGSIHLQSKPEVGSQAQAGNAIKLTETLPAHSVIGRDQESTQADPSEPPGPSDSEEAGDAAVQEEERGDDEPNPKRRQCRQVDVVTSEATLPHKTVTEPKIIVQTRSEVDLLDDGYRWRKYGQKVVKGNPHPRSYYKCTSAGCNVRKHVERAAADPKAVVTTYEGKHNHDVPAARNSSHNTANTSASQVKPQKVVTEKHPLHKGMEFGNNDQRPVLLQLKEEKIAV

SEQ ID NO: 1189 - DNA, 1476 bp, Populus trichocarpa
  POPTR_0008s09140.1
atggctgatgaaaaggagcatcagcagccaaaacagcagcagccatcttcccgcccgatcaccataacactccctccacgttccttcaccgaaactttcttgtccagtggtcctcctggttccatgggcttcagtccaggtcctatgactcttctctctgggttcttctccgactcggacgactgcaagtccttctctcagcttcttgccggcgccacggcctcccctaatttcaaaccaaccgatgacaagagctccgccggggactttagcaggccgggaaacttgtcgatcgtccctccctcgccgatgttcacgatgccgctggggctctgtccggtggctcttcctgattcaccggggttcgagctcttctctcctgagggctttggaatgatacaccagcaggcactagcacaggtcacggcacaggctgcacaagccaattcaaatatgcatgttcaacaggagtattcgacatcggcaatgtcttcgacacagtttttgacctctatcaataattcagcagcgcagcagcagcagcagcagcaaatggcaggctcagtaacggactctagagttacagtgcaggaactgtcgggcattcctcacgctgatcggatcagatccgaatcttcttctttggctgttgacaagcccactgatgatggatacaactggaggaaatatgggcagaaacaggtgaaaggaagcgaatttcctagaagttattataaatgtacacatcctaactgtcctgtcaagaaaaaagttgagcgatcacttgatggtcaagtaactgaaattatctacaaggggcaacacaatcatgaaccaccacaacccaataagcgtggaaaggaagggataaacggcaattcaaacagtcaggggaattttgaaatggctacccttcaaagtggatatgtcagaaaaacgagagataggaaggatcaggaatccagtcaagctacacctgaacatgtatctgggatgagtgattctgaggaagttagtgacactgaaactggtggtcggattgatgaagatgagcctggtcataagagaagaataactacagaggttagagtgacagaaccagcttcttcacacaggactgtgacagagtctagaatcgttgtgcagacaaccagtgaagttgatctcttagatgacggctatagatggcgcaagtatgggcagaaagttgtcaaaggcaatccttatccaaggagttactataaatgcacaaccccaggatgcaaagtccgtaaacatgtagagagggctgcagcagaccctcgagccgttataacagcctatgagggcaaacataatcacgatgtaccagcagctaaaaatagcagccacatcacagtcaatagcaatgcatctcagctgaaaccacaaactctggagaagcgtgcatcaaacaacagcaacaatcaacagcctatagcacgtttgcggttaaaa

SEQ ID NO: 1190 - protein, 492 aa, Populus trichocarpa
  POPTR_0008s09140.1 polypeptide
MADEKEHQQPKQQQPSSRPITITLPPRSFTETFLSSGPPGSMGFSPGPMTLLSGFFSDSDDCKSFSQLLAGATASPNFKPTDDKSSAGDFSRPGNLSIVPPSPMFTMPLGLCPVALPDSPGFELFSPEGFGMIHQQALAQVTAQAAQANSNMHVQQEYSTSAMSSTQFLTSINNSAAQQQQQQQMAGSVTDSRVTVQELSGIPHADRIRSESSSLAVDKPTDDGYNWRKYGQKQVKGSEFPRSYYKCTHPNCPVKKKVERSLDGQVTEIIYKGQHNHEPPQPNKRGKEGINGNSNSQGNFEMATLQSGYVRKTRDRKDQESSQATPEHVSGMSDSEEVSDTETGGRIDEDEPGHKRRITTEVRVTEPASSHRTVTESRIVVQTTSEVDLLDDGYRWRKYGQKVVKGNPYPRSYYKCTTPGCKVRKHVERAAADPRAVITAYEGKHNHDVPAAKNSSHITVNSNASQLKPQTLEKRASNNSNNQQPIARLRLK

SEQ ID NO: 1191 - DNA, 1497 bp, Populus trichocarpa
  POPTR_0010s17040.1
atgaccgaaaatggaaaggagcatcagcagccaaaacagcaacaaccatcatcaccttccaaatcattgtcttcccgcccgaccaccataacactccctccacgttccttcaccgaaacattcttttccagtggggcccctggtaccttgggcttcagtccaggccctatgactcttctctcaagtttcttctctgactccgacgactgtaagtccttctctcagcttctcgctggcgccatagcctcccctaatttcaaacctcccgatgacaagagctctgccggtgactttagcagttcatcgagcttgtccatcgtccctcccccgccgatgttctcgatgccgctggggcttagtccggtgtctcttcctgattcaccggggtttggactcttttctcctcagggctttggaatgacacaccagcaggcgctagcacaggtcacggctcaggctgcgcaagccaattcaattatgcatgttcaaccggaatattcgacaccggcaatgtcttcgacctttacgagcacacaaggggcacaccagcagcagcagaaggtacgctcagtcgcggattctagagtgaaaatacaggaactctcggacttctctcggtctgatcagagatctgaatcttcttcgctggctgttgataagcctgctaatgatggatacaactggaggaaatatgggcagaaacaagtgaaaggaagtgagtatcctagaagttattataaatgtacacatcctaattgtcctgtcaagaaaaaagttgagcgatctcttgatggtcaagtaactgaaattatctacaaggggcaacacaatcatcagccaccgcaatccaataagcgtggaaaggatactggaggcttaaatggcaattcaaacagtcacgggaattctgaattagattcccgatttcaaagtggaaatgtcagcaaagagagagataggaaggatcaggaatccagtcaagctacacctgaacatatatctgggatgagtgatagtgaggaagttggtgatactgaagctggtggtgaagttgatgaagacgagcctgatcctaagagaagaagtacagaggttagagtgacagagccagcttcttcacacaggactgtaacggagcccagaatcattgtgcagacaaccagtgaagttgatctcttagatgatggctatagatggcgcaagtatgggcagaaagttgtcaaaggcaatccttatccaaggagctactataaatgcacaaccgcaggatgcaaagttcgtaaacatgtcgagagggctgcagcagacccaaaagctgtcataacaacctatgagggcaaacataatcacgatgtaccagcagctaaaaatagcagccacaacacagtcaatagtaatgcatctcagctgaaaccacaaactctggagaagcatgcatcaaacaacagcaacagtcagcctgcagcacgtctacggttaaaagaagagcagataaca

SEQ ID NO: 1192 - protein, 499 aa, Populus trichocarpa
  POPTR_0010s17040.1 polypeptide
MTENGKEHQQPKQQQPSSPSKSLSSRPTTITLPPRSFTETFFSSGAPGTLGFSPGPMTLLSSFFSDSDDCKSFSQLLAGAIASPNFKPPDDKSSAGDFSSSSSLSIVPPPPMFSMPLGLSPVSLPDSPGFGLFSPQGFGMTHQQALAQVTAQAAQANSIMHVQPEYSTPAMSSTFTSTQGAHQQQQKVRSVADSRVKIQELSDFSRSDQRSESSSLAVDKPANDGYNWRKYGQKQVKGSEYPRSYYKCTHPNCPVKKKVERSLDGQVTEIIYKGQHNHQPPQSNKRGKDTGGLNGNSNSHGNSELDSRFQSGNVSKERDRKDQESSQATPEHISGMSDSEEVGDTEAGGEVDEDEPDPKRRSTEVRVTEPASSHRTVTEPRIIVQTTSEVDLLDDGYRWRKYGQKVVKGNPYPRSYYKCTTAGCKVRKHVERAAADPKAVITTYEGKHNHDVPAAKNSSHNTVNSNASQLKPQTLEKHASNNSNSQPAARLRLKEEQIT

SEQ ID NO: 1193 - DNA, 1662 bp, Citrus clementina
  clementine0.9_006505m
atggaagatttagaaaagtcggaatataaacaacgatttgaaataaacattaaccaaaggaggaaagaaagaagcctattaccacacattcaagttttgtttctgaataaaccaactttgtgcacaaaggccaaagctcagaccttttattttactgaaatggcaagtgggaaagaggacttaacaaagaagaagcgcccaacaatcattctccctcctcgtccttcaatggagtctttatatgggtctggtttgagccctggacccatgactctggtgtctagcttctttgctgaggacttgaacaatcaatctttctctcagcttcttgctggagccatggcttctccattggcatctaagcaagctcagagctttttggttgattacagtaaagatggggatggagatggggacgacaagagttatggttttaaagagaataggccaacaagtttgatgattgcaaggtctccattgtttactgttcctcctgggttaagcccttctgggttgcttaattcacctggcttcttttcacctcagagcccatttggaatgtcccaccagcaggcgttggctacagttacagctcaagctttcctagctcaatctagtatgcacatgcaagctgaatatcaaccttcattgttatcagctccagaagagtcattgacttgtaatctatcagtcactcccaatgaaccttctcaacagcagatgccacattcaaactcagcccctcaaagttctatgatggaaccactggaggtctctcattctgatgggaaacatatgcatccttctgctgtagataaacccgctgatgatggctacaactggcgtaaatatgggcagaagccaattaagggcaacgaatatcctcgaagctactacaaatgtacacatgtaaattgccctgtcaaaaagaaagttgagcgttcttctagtgcccaaataactcagattatctacaaaaacgagcacaaccatgaaaagcctcaactcagtaaacgtgcgaaagatagcagtgatgcaaatgaaaataataattctcaggctaatcctgaacctgttttgcaaggtcaaactctatatgctagttctgttctaggaagtaatcaggaatctgctcaagcagcccccatacatcttgctgactcaagtgacagtgaggagctaggtgatgcagagaatagaaaagagggagatgatgatgagccaaacactaagagaaggaacatcgctgtagaatcagaggtagtgttgtctcaaaagacagtcacagagccaaagatcattgtgcagacaagaagtgaagttgatcttttagatgatggctacaggtggcgtaagtatggacagaaagtggtcaaagggaacccccatccaaggagctactacaaatgcactaatcccggatgcaatgttcgtaagcatgttgagagagctccaacagaccccaaagctgtcgtaactacatatgaggggaaacataatcatgatgtcccagcagcaaaaaatggcagccattgtgcaccaccacggctaaaaccaaacaaagtggtgactgagaagcaccccttacttaaagacatggatttcggacatgatgaccaaagaccagtgcttctccggctaaaggaagagcaaatcatagtg

SEQ ID NO: 1194 - protein, 554 aa, Citrus clementina
  clementine0.9_006505m polypeptide
MEDLEKSEYKQRFEININQRRKERSLLPHIQVLFLNKPTLCTKAKAQTFYFTEMASGKEDLTKKKRPTIILPPRPSMESLYGSGLSPGPMTLVSSFFAEDLNNQSFSQLLAGAMASPLASKQAQSFLVDYSKDGDGDGDDKSYGFKENRPTSLMIARSPLFTVPPGLSPSGLLNSPGFFSPQSPFGMSHQQALATVTAQAFLAQSSMHMQAEYQPSLLSAPEESLTCNLSVTPNEPSQQQMPHSNSAPQSSMMEPLEVSHSDGKHMHPSAVDKPADDGYNWRKYGQKPIKGNEYPRSYYKCTHVNCPVKKKVERSSSAQITQIIYKNEHNHEKPQLSKRAKDSSDANENNNSQANPEPVLQGQTLYASSVLGSNQESAQAAPIHLADSSDSEELGDAENRKEGDDDEPNTKRRNIAVESEVVLSQKTVTEPKIIVQTRSEVDLLDDGYRWRKYGQKVVKGNPHPRSYYKCTNPGCNVRKHVERAPTDPKAVVTTYEGKHNHDVPAAKNGSHCAPPRLKPNKVVTEKHPLLKDMDFGHDDQRPVLLRLKEEQIIV

SEQ ID NO: 1195 - DNA, 1575 bp, Citrus clementina
  clementine0.9_007348m
atggctggaaatgaagaccgggcgtcaacggcctcatcagcgtcgttaaaaccatcgaccactccttcacgaccgacaatcactctcccgccacgtgcctcatttaccgagtctttatttaataacaacgggccgggttccgggttcggcttcggattcagccccggccccatgactttagtttccaacttcttcgccgactccgacgactgcaagtccttctctcagctactcgccggcgccatgtcctctcccgccgccggccacttgagaccgaatttttcggaacaggcggggaggggttcgggcgatgccgaagctggtgacgcggacttccggttcaagcagaatagaccggctggtctggtgattgcgcaaccgccgccgatttttgccgtgccgcccgggttgagccccgcaactctgcttgaatcgccgaatttcggtttgttttcgcctgcacagggagcatttggaatgacgcaccagcaagccctagcacaggtcactgcccaagctgcacaagcccaatctcatacacaaatccctgctgaatatccatcttctttatcatcagcacccaccacatctatgacgcaagtttcatctttgactgccaatacaaccacaaaccaacagatgacacccctaatgccggactctagtgtacaaatgaaggaatcctcagatttctctcactctgatcagagaccccaatcttcttcttatgtttctgataagcctgctgatgatccctacaactggcgaaaatatgggcagaagcatgtgaagggcagtgaatttcctcgaagttattacaaatgcacacatcctaattgtcctgtcaagaagaaggttgaacgatctttagatggtcaagtaactgaaattatctacaaggggcagcataaccatccgccacctcaatcaaataaacgtgccaaggatgctggaagtttaaatgggaatttaaataaccaggggagttctgaattagctccccaattgaaagaaggggctggttattccatgtctaaaaaggatcaagaatctagccaggttacaccggaaaatatatctggtacaagtgacagcgaagaagtgggtgatgctgaaactgctgtatttgagaaagatgaagatgagcctgatgcaaaaagacgaagtacagaaatcagagtttcagagccaacggcctcacataggactgttacagagcctagaattattgttcagacaactagtgaagttgatcttttggatgacggctacagatggcgcaagtatggccagaaagttgtaaaaggcaatccttatccaaggagctattataaatgcacaaccactggttgcaatgtccgtaagcacgttgagagagcatctacggaccctaaagctgtcataacaacatacgaaggcaaacataatcatgatgtaccggctggtaagaatagtagccacaacacagccaacagtaatgcatcacagataaaaccacacaatactgggacaaacttagggaacaataatcaacagcccatagctcgtttacggctaaaagaagagcatttgacg

SEQ ID NO: 1196 - protein, 525 aa, Citrus clementina
  clementine0.9_007348m polypeptide
MAGNEDRASTASSASLKPSTTPSRPTITLPPRASFTESLFNNNGPGSGFGFGFSPGPMTLVSNFFADSDDCKSFSQLLAGAMSSPAAGHLRPNFSEQAGRGSGDAEAGDADFRFKQNRPAGLVIAQPPPIFAVPPGLSPATLLESPNFGLFSPAQGAFGMTHQQALAQVTAQAAQAQSHTQIPAEYPSSLSSAPTTSMTQVSSLTANTTTNQQMTPLMPDSSVQMKESSDFSHSDQRPQSSSYVSDKPADDPYNWRKYGQKHVKGSEFPRSYYKCTHPNCPVKKKVERSLDGQVTEIIYKGQHNHPPPQSNKRAKDAGSLNGNLNNQGSSELAPQLKEGAGYSMSKKDQESSQVTPENISGTSDSEEVGDAETAVFEKDEDEPDAKRRSTEIRVSEPTASHRTVTEPRIIVQTTSEVDLLDDGYRWRKYGQKVVKGNPYPRSYYKCTTTGCNVRKHVERASTDPKAVITTYEGKHNHDVPAGKNSSHNTANSNASQIKPHNTGTNLGNNNQQPIARLRLKEEHLT

SEQ ID NO: 1197 - DNA, 1296 bp, Oryza sativa
  LOC_Os07g40570.1
atggcggccgcgcggcgggtggcgggcggcggcggtggcagcctgtggggcccgcctcagccgccgccgtcgaccggagggggcatcccccagctccccgccgcggccgccgccccagtggagggcctcctcgacgcccccttctcttcctcctccggtggcggtggcggcggctggccgccgccgccgccgccgctctccggcaccgccgtcctcatcgggtacccccagggcaactttgaaactttccctcaacaggacttggtacctttaacagcacaagaggttcattctaagtgcattacattcggtcgagcagagaacctgccttttatccctttggcgacttcagcgctggtctcccaacatactggttcttcttctgtaaatgtgacaccgttgcaagaaattctgacttcgccgtcgcaaataagcaatgtcaacactgaatctattggggtgttacaagggctcccagcttcatccatcgttctggatagacctactgatgatggatacaactggcgaaagtatggtcagaaggcagtgaagggtggggaatatccaaagagctactacaaatgcacccatctgaactgtttggtcaggaaaaatgtggagcactctgcagatggacgaatcgttcagataatttacagaggacaacacactcatgaacggccctcaaaaaggaggtttaaagattgtggtggtatatcagatgatttagacgatttcagtggcaccacgggcacttcagtcagatcacagcctgattacgatgattactgcagaaagcctatcattccaagtggcaccatggttgctcctttagtgaaaaagattgaagatggtgatgaccaattgtctggatcaagtgataaccaggatgagcatgatgatgaggtgaggacttctgatggagcttccggtgatgccagtgcaaatgaaaggaatgtgccagccccaggtcaaaagattatagtgagtacaaccagtgagatcgatcttttggatgatggttataggtggcgaaaatatggacagaaagtggtgaaaggaaatccttacccaaggagttattacaaatgcacctacctaggctgtgatgtaaagaagcaagttgagagatctgttgaggaaccaaatgctgtgataactacatacgaggggaagcatatccatgatgtgcctgctgcaaggaacaaaagccatgtcgtagccaatgcctctctattgcagaacacaaagtcgaatacctactgcacagagcaatcctacacaacgatcacttgc

SEQ ID NO: 1198 - protein, 432 aa, Oryza sativa
  LOC_Os07g40570.1 polypeptide
MAAARRVAGGGGGSLWGPPQPPPSTGGGIPQLPAAAAAPVEGLLDAPFSSSSGGGGGGWPPPPPPLSGTAVLIGYPQGNFETFPQQDLVPLTAQEVHSKCITFGRAENLPFIPLATSALVSQHTGSSSVNVTPLQEILTSPSQISNVNTESIGVLQGLPASSIVLDRPTDDGYNWRKYGQKAVKGGEYPKSYYKCTHLNCLVRKNVEHSADGRIVQIIYRGQHTHERPSKRRFKDCGGISDDLDDFSGTTGTSVRSQPDYDDYCRKPIIPSGTMVAPLVKKIEDGDDQLSGSSDNQDEHDDEVRTSDGASGDASANERNVPAPGQKIIVSTTSEIDLLDDGYRWRKYGQKVVKGNPYPRSYYKCTYLGCDVKKQVERSVEEPNAVITTYEGKHIHDVPAARNKSHVVANASLLQNTKSNTYCTEQSYTTITC

SEQ ID NO: 1199 - DNA, 1431 bp, Oryza sativa
  LOC_Os03g33012.1
atggcggcgcacgagggcggcggcaacggcgcccgccgcccgcccgcgccgccgctgctccccacgctctcgctgcccccgcgatccgcggccggttccctcttctccgccgagtccagccccggcgcgctcactctcgccgcctcgctcttccccgacgcgccctccccggccttccagggctctttcacccagctcctcgtcggcgccatgggctaccccgccgcctccgcccccgctccgccctcaccgttcccggtgccgcacggactcagccccaccgcgttcctcgggggctcccccggcctcttctccccgacggggaactttgaaatgtcccatcaacaagccttggcacaagtaacagcagaagcagtccattctccgtacagtatgattaatcaatcagatttctcactcccgttctcgtcgacaacgacttcagtgttggcatcacaacatgtcaactcttctgccaatgtgtcatcaccacgagaaataccaactctgccatcccacacagataatagcaacattgaatcaactgaggtttcacatggattccaaactactgccctcactgaggataaacctgctgatgatggctacaactggcggaagtatggccagaaggcagttaagggtggggagtatccaaggagctattataaatgtacccatttaagctgtccagttaagaagaaagtggagcgctcatctgacggacagattactcaaatactttatagaggccagcataaccaccaacgaccaccaaaaagaaggtccaaagatggtggcgctttactaaatgaagcagatgtttcccctgagaaggaagatgcatcaactagatcagaacagggctcccaagattattctggaaaattcaaggcatcaaatgatggtggtccttcatcatccaggaggggagataggggtgagcaaatatcgggctcaagtgatagcaacgatcaaggcgaggaagaagtgaaggttgagggtagagctactagtgatggaaatgcgaacaaaagacatgtgccagctccagctcaaagaatcattgtgcaaacaactagtgaggttgatcttttggatgatggctaccgatggcgcaagtatggtcaaaaagtagtaaaagggaatcctcacccaaggagttactacaaatgcacgtaccaaggatgtgatgtgaagaagcatattgagagatcctcacaagacccaaaggctgtgataactacatatgaaggcaagcacagccatgacgtgccagcagccaggaacagtagccattcttccgctaatgccaacgtatcgtcttccagcaatttacctcacaaggacagggggcaacggtcgtcgtgcagagatggtttgcggaatgcatcttcagtttcttccttacagttaaaagaagagagtgga

SEQ ID NO: 1200 - protein, 477 aa, Oryza sativa
  LOC_Os03g33012.1 polypeptide
MAAHEGGGNGARRPPAPPLLPTLSLPPRSAAGSLFSAESSPGALTLAASLFPDAPSPAFQGSFTQLLVGAMGYPAASAPAPPSPFPVPHGLSPTAFLGGSPGLFSPTGNFEMSHQQALAQVTAEAVHSPYSMINQSDFSLPFSSTTTSVLASQHVNSSANVSSPREIPTLPSHTDNSNIESTEVSHGFQTTALTEDKPADDGYNWRKYGQKAVKGGEYPRSYYKCTHLSCPVKKKVERSSDGQITQILYRGQHNHQRPPKRRSKDGGALLNEADVSPEKEDASTRSEQGSQDYSGKFKASNDGGPSSSRRGDRGEQISGSSDSNDQGEEEVKVEGRATSDGNANKRHVPAPAQRIIVQTTSEVDLLDDGYRWRKYGQKVVKGNPHPRSYYKCTYQGCDVKKHIERSSQDPKAVITTYEGKHSHDVPAARNSSHSSANANVSSSSNLPHKDRGQRSSCRDGLRNASSVSSLQLKEESG

SEQ ID NO: 1201 - DNA, 1620 bp, Oryza sativa
  LOC_Os12g32250.1
atgtccgcgcgccccccgccgccgccgcgcccgaggctcgcgctgccgccgcgctcggccgccgagtcgctcttcacgggcgccggcgacgccagtccgggccccctcaccctcgcctccgcgctcttcccctccgaccccgacggcggcggcggcggcggcggcgtcatgacgtcgtcctcctcctccgccgcgggggccacgagcttcacgcagctgctcatcggcaacctctccgcgcctcctcctcctcctcctcctccgcagcagcagcagcagcgtgaggcggcgcgaggaggcggggtcgcgagggccgggccggcgctgtcggtggcgccgccgccgacggcggggtcggtgttcaccgtgccgcccgggctcagcccctccggccttctcgactcccccgggttgctcttctcgccggccatgtttgatgcttttgatgtccttgatatgttcatacctgataagatccttccaaaacgcgctactcggattaagttggacatctactttgtaaagacaagtcctgaagggggttttgggatgtcgcatcgggaggctcttgcccaagtcacagcccaagcaagccattctccactcagaatgttcgatcacactgaacaaccatcattctcagcagctccaacatcatctgaagctatgcagcatatgaatgcagcagttaatatgacaggaatttcagacatggtcatgggtccaacaaacaatgagaatgtagcctttcaacctgctgaggcgtctcagaggtatcaagtcaatgcccctgttgataagcctgccgatgatggctataattggcggaagtatggtcagaaggtggtgaaaggcagtgattgcccaagaagctattacaaatgtactcaccccaattgtccggtcaagaaaaaggtagagcatgcagaagatggtcagatatctgagatcatatacaaaggcaaacacaatcaccaacgtccaccaaacaagcgggcaaaagatggcagctcttcagcagctgatcaaaacgagcaatctaatgataccgtgtctggtctgtcaggtattaagagagatcaggaagctatatatggaatgtctgagcaactatctggtttaagtgaaggagatgatatggatgatggtgaatcaaggccacatgaagcagatgacaaagagagcgacagcaagaaaaggaatatacaaatttcttcacagaggacttcagcggaagctaagattattgtgcaaacaaccagtgaggttgatcttttggatgatggttatagatggcgcaagtatgggcagaaggtggttaaaggaaaccctcatccaaggagttactacaagtgcacctatgctggatgtaatgttaggaaacacattgagagggcttcgtcagaccctaaggctgtcataacaacttatgaaggaaaacataaccatgaaccaccggttggtaggggaaacaaccagaatgcgggaaatgcggccccttcaagcagtgcacaacagaatatgcagaatttgtctagtaatcaagcttcacttacaatggcagacttcaacaacattaaccagaggccaattggggtcttacagttcaaaagcgaagaa

SEQ ID NO: 1202 - protein, 540 aa, Oryza sativa
  LOC_Os12g32250.1 polypeptide
MSARPPPPPRPRLALPPRSAAESLFTGAGDASPGPLTLASALFPSDPDGGGGGGGVMTSSSSSAAGATSFTQLLIGNLSAPPPPPPPPQQQQQREAARGGGVARAGPALSVAPPPTAGSVFTVPPGLSPSGLLDSPGLLFSPAMFDAFDVLDMFIPDKILPKRATRIKLDIYFVKTSPEGGFGMSHREALAQVTAQASHSPLRMFDHTEQPSFSAAPTSSEAMQHMNAAVNMTGISDMVMGPTNNENVAFQPAEASQRYQVNAPVDKPADDGYNWRKYGQKVVKGSDCPRSYYKCTHPNCPVKKKVEHAEDGQISEIIYKGKHNHQRPPNKRAKDGSSSAADQNEQSNDTVSGLSGIKRDQEAIYGMSEQLSGLSEGDDMDDGESRPHEADDKESDSKKRNIQISSQRTSAEAKIIVQTTSEVDLLDDGYRWRKYGQKVVKGNPHPRSYYKCTYAGCNVRKHIERASSDPKAVITTYEGKHNHEPPVGRGNNQNAGNAAPSSSAQQNMQNLSSNQASLTMADFNNINQRPIGVLQFKSEE

SEQ ID NO: 1203 - DNA, 1350 bp, Zea mays
  GRMZM2G008029_T01
atggacgaccggcgcgggcgcggcgacgcgttgggccagaggccgttcgcgtctgctgctcagagacaggaaagggtgttcgacggtggaggcggaggcggtggcggcggccatgggccagcgtttggcgacgagtttgatcaggggtcgtccctcatggcgcttctcagcgctggcgcacgtgcagtgagctcccagccaccgccgccgacgtggggcgtggaggaggtgaccgcggcgcctgccattaacctggtgcctcaatcgttctccatgtgtttcagtgcaattgacaataatatatacctcaaagatcacaatagtatgatatgtttcctctcaatgaaggcaaactacgcgccaccgccgccgtcctaccagtaccagcaaccgacctcattcgccccatcgccgctgggcggcagaatggatccctacgcgccgtaccttcacgtagaccagccgccgcaatggcctcctccccgagcgacggttgttggttcctccctgccgcactccaacttcaccgtcctcttccccagcaatccatacgagcatgacatgcagctgcgagcgaccgcgctattcggcggcggcggcggctcatactcatacacgctgccgccgccgccgccgctggccatcgagcagccagcgaaggacggttacacctggcgcaagtacgggcagaagcagctcaaggacgccgagtcaccacgaagctactataagtgcacccgcgacgggtgccccgtcaagaaggtcgtggagcgctccttcgacgggctcatcaaggagatcacctacaagggccgccacaaccacccgcgcccgcaggaaggcggcctcgccggcggtgggaacgatgccggcctcgctgccgccgaggaggacgcggaaggcccgagcgacgacgatgacgacgcgtcgatgcatgaggatgacgtcgagggtgctcctggcatgggcgcggacggcgtgggcgggcagagggtggtgaagaagcccaagatcatcatccaaacgcggagcgaggtggatctcctggacgacggctaccggtggcgcaagtacgggcagaaggtagtcaagggcaacccccggccgaggagctactacaagtgcaccgcggataactgcaacgtgcgcaagcagatcgagagggcgaccaccgaccccaggtgcgtcctgacgacgtacaccggccgccacaaccacgacccgcacccgccgggccggggcaacgaagccgctgccggcggctcttcggctgatccggccccttcatctgcgaacacggctactggaactgggggctcggcagctgatggaggagtgctagccgggaaa

SEQ ID NO: 1204 - protein, 450 aa, Zea mays
  GRMZM2G008029_T01 polypeptide
MDDRRGRGDALGQRPFASAAQRQERVFDGGGGGGGGGHGPAFGDEFDQGSSLMALLSAGARAVSSQPPPPTWGVEEVTAAPAINLVPQSFSMCFSAIDNNIYLKDHNSMICFLSMKANYAPPPPSYQYQQPTSFAPSPLGGRMDPYAPYLHVDQPPQWPPPRATVVGSSLPHSNFTVLFPSNPYEHDMQLRATALFGGGGGSYSYTLPPPPPLAIEQPAKDGYTWRKYGQKQLKDAESPRSYYKCTRDGCPVKKVVERSFDGLIKEITYKGRHNHPRPQEGGLAGGGNDAGLAAAEEDAEGPSDDDDDASMHEDDVEGAPGMGADGVGGQRVVKKPKIIIQTRSEVDLLDDGYRWRKYGQKVVKGNPRPRSYYKCTADNCNVRKQIERATTDPRCVLTTYTGRHNHDPHPPGRGNEAAAGGSSADPAPSSANTATGTGGSAADGGVLAGK

SEQ ID NO: 1205 - DNA, 1491 bp, Zea mays
  GRMZM2G171428_T01
atggcggcccgcgaggcctccgccccggctccggcttcgccccacgcaggcgacgggccgggccgcccgccgcggcccacgctcgccctgcccccgcgctccgccgtcgagtccctcttcgccaccggcgcctcctcctcggccggcgccgccgagaccagccccggcccgctcaccctcgccgccgcgctcttccccgacgcgtcctccccggccttccacggctccttcacccagctcctcgtcggcgccataggctccccggccgtaccctcgccgccctctccgttcgccgtcccgccggggctcagcccggccacgctcttcggctcaccgggcctattctctcccacggggagttttgagatgtcccatcaacaagccttagcacaagtaacagcacaagcagttcattctcagtacaatatgataaatcacacagattacagtattcctttttcgtcgacaacagcaccagctttgatcacagcacagcatgccaattcttctgccaatgtggcatcagcacaggagaaaccagctctgccgtcacatgcaggtaatagcaacattgaatcaaatgaggtttcacaaggactcaaaacttctgcacccacttttgataaacctgctgacgatggatacaactggcggaagtatggccagaaggcagttaagggtggcgagtatccaaggagttactacaaatgtacccacacgagttgtccagttaagaaaaaagtggagcgctcagcagaaggacacatcactcaaataatttatagaggtcagcacaaccaccagcgtccaccaaaaaggaggtccaaagatggtggtggtccactaaatgaagcagatgttcttcatgagaatgaagacatttcaactagatcagaacctggctctcaagaacactctggaaaacatgaagggtcaaatgatggcatattagggccttctgtgtcaagaaggggaggaggagatgagcaattgtcaggctcaagtgatagtgatgaggaacaagatgatgaacaaagggctggcgacgaagaccctggctatgcaaatgcaaacaaaagacatgtgccaactccagctcaaaggataattgtgcaaacaaacagcgaagttgatcttctggatgatggctatcggtggcgcaagtatggacagaaagtggtaaaagggaatccctacccgaggagctactatagatgcacgtaccaaggatgcgatgtgaagaagcatatcgaaagatcatcccaagacccaaaggccgtcataacgacttacgaagggaagcacagccatgatgttccagcagtcaggaacggtagccatgctgctgccaacgccaatgggtcatcttccaccagcttaccagtaccacacagggtccacagttcagcatccagtagtcgcagagcggcagaattacaaagcgcatcctcagcttcttctatgctactaaaagaggaaaacgaaataaca

SEQ ID NO: 1206 - protein, 497 aa, Zea mays
  GRMZM2G171428_T01 polypeptide
MAAREASAPAPASPHAGDGPGRPPRPTLALPPRSAVESLFATGASSSAGAAETSPGPLTLAAALFPDASSPAFHGSFTQLLVGAIGSPAVPSPPSPFAVPPGLSPATLFGSPGLFSPTGSFEMSHQQALAQVTAQAVHSQYNMINHTDYSIPFSSTTAPALITAQHANSSANVASAQEKPALPSHAGNSNIESNEVSQGLKTSAPTFDKPADDGYNWRKYGQKAVKGGEYPRSYYKCTHTSCPVKKKVERSAEGHITQIIYRGQHNHQRPPKRRSKDGGGPLNEADVLHENEDISTRSEPGSQEHSGKHEGSNDGILGPSVSRRGGGDEQLSGSSDSDEEQDDEQRAGDEDPGYANANKRHVPTPAQRIIVQTNSEVDLLDDGYRWRKYGQKVVKGNPYPRSYYRCTYQGCDVKKHIERSSQDPKAVITTYEGKHSHDVPAVRNGSHAAANANGSSSTSLPVPHRVHSSASSSRRAAELQSASSASSMLLKEENEIT

SEQ ID NO: 1207 - DNA, 1482 bp, Zea mays
  GRMZM2G076657_T01
atgtccgcgcgcccgccgccgccgccgcgcccgcgtctggcgctgccaccgcgctcaacggcggagtcgctctttacgggcgccggcgacgccagccccggcccgctcacgctcgcctcagcgctcttcccatctgatgccgacggcggcggtggccccggaggcgcctcctcctccgcggccggggccgcaaccttcacgcagctccttactggctccctcgcgccgcctccgcagcagcagcagcatgaagcgcagacgggaggaggaggggtcgcgagggccggcccggcgctctcggtggcgccgccggcgtcctcgttcgctggcgcgtccctgttcacggtgccccccggcctcagcccctccggtttgctcgactcccctgggctgctcttctcgccggccatgggggggtttggaatgtcgcaccagcaggctctggctcaagttacagcccaagcaacccattctccactcagaatgtttgatcaccttgaacagccatctttctccacagctgcaacaacttctggagctctacaccatatgaattctgcagccagtatggcaggaatttcagatatgacaatggcaacagcaaacaatgagaatccatcctttcagtctgctgaggcatcccaaaggtatcaagttaatgcccctgttgataagccagctgatgatggctataactggcggaaatatggtcagaaggtggtaaagggcagtgattgtccaaggagctattacaaatgcacccatcccaattgtcctgtcaagaaaaaggtagagcatgcagaagatggtcagatatctgagatcatatacaaaggcaaacacaatcaccaacgtccaccaaataagcgggcaaaagacggcaactcttcagcatttgatcaaaatgaacaatctaatgataccacatctggcttgtcaggtgccaagagagatcaggacaatatatacgggatgtctgagcaagcatatggtttaagtgatggagatgatatggatgatggtgaatcaaggccacacgaagtggatgacgctgataatgagagtaaaagaaggaatatacaaatttcttcacaaaggaccttgtcagagtctaagatcattgtgcaaacaactagtgaggttgatcttttggatgatggttatagatggcgcaagtatgggcagaaggtagtcaaagggaattctcatccaaggagttactacaaatgcacatttgctggatgcaatgtccggaagcacattgagagggcttcgtcagaccccagggctgtcataacaacctatgaaggaaaacatgaccatgaaccgccggttggtcggggcaacaaccagaatgcaggaataccacaacagaaagaagggcagaacaatatatcaagtaatcaagcttcactttcgaggccagattttagcaacgctaaccagatgccaattggaatcttacaattcaagagcgagcaa

SEQ ID NO: 1208 - protein, 494 aa, Zea mays
  GRMZM2G076657_T01 polypeptide
MSARPPPPPRPRLALPPRSTAESLFTGAGDASPGPLTLASALFPSDADGGGGPGGASSSAAGAATFTQLLTGSLAPPPQQQQHEAQTGGGGVARAGPALSVAPPASSFAGASLFTVPPGLSPSGLLDSPGLLFSPAMGGFGMSHQQALAQVTAQATHSPLRMFDHLEQPSFSTAATTSGALHHMNSAASMAGISDMTMATANNENPSFQSAEASQRYQVNAPVDKPADDGYNWRKYGQKVVKGSDCPRSYYKCTHPNCPVKKKVEHAEDGQISEIIYKGKHNHQRPPNKRAKDGNSSAFDQNEQSNDTTSGLSGAKRDQDNIYGMSEQAYGLSDGDDMDDGESRPHEVDDADNESKRRNIQISSQRTLSESKIIVQTTSEVDLLDDGYRWRKYGQKVVKGNSHPRSYYKCTFAGCNVRKHIERASSDPRAVITTYEGKHDHEPPVGRGNNQNAGIPQQKEGQNNISSNQASLSRPDFSNANQMPIGILQFKSEQ

SEQ ID NO: 1209 - DNA, 1431 bp, Zea mays
  GRMZM2G076657_T02
atgtccgcgcgcccgccgccgccgccgcgcccgcgtctggcgctgccaccgcgctcaacggcggagtcgctctttacgggcgccggcgacgccagccccggcccgctcacgctcgcctcagcgctcttcccatctgatgccgacggcggcggtggccccggaggcgcctcctcctccgcggccggggccgcaaccttcacgcagctccttactggctccctcgcgccgcctccgcagcagcagcagcatgaagcgcagacgggaggaggaggggtcgcgagggccggcccggcgctctcggtggcgccgccggcgtcctcgttcgctggcgcgtccctgttcacggtgccccccggcctcagcccctccggtttgctcgactcccctgggctgctcttctcgccggccatgggggggtttggaatgtcgcaccagcaggctctggctcaagttacagcccaagcaacccattctccactcagaatgtttgatcaccttgaacagccatctttctccacagctgcaacaacttctggagctctacaccatatgaattctgcagccagtatggcaggaatttcagatatgacaatggcaacagcaaacaatgagaatccatcctttcagtctgctgaggcatcccaaaggtatcaagttaatgcccctgttgataagccagctgatgatggctataactggcggaaatatggtcagaaggtggtaaagggcagtgattgtccaaggagctattacaaatgcacccatcccaattgtcctgtcaagaaaaaggtagagcatgcagaagatggtcagatatctgagatcatatacaaaggcaaacacaatcaccaacgtccaccaaataagcgggcaaaagacggcaactcttcagcatttgatcaaaatgaacaatctaatgataccacatctggcttgtcaggtgccaagagagatcaggacaatatatacgggatgtctgagcaagcatatggtttaagtgatggagatgatatggatgatggtgaatcaaggccacacgaagtggatgacgctgataatgagagtaaaagaaggaatatacaaatttcttcacaaaggaccttgtcagagtctaagatcattgtgcaaacaactagtgaggttgatcttttggatgatggttatagatggcgcaagtatgggcagaaggtagtcaaagggaattctcatccaaggagttactacaaatgcacatttgctggatgcaatgtccggaagcacattgagagggcttcgtcagaccccagggctgtcataacaacctatgaaggaaaacatgaccatgaaccgccggttggtcggggcaacaaccagaatgcaggaataccacaacagaaagaagggcagaacaatatatcaagtaatcaagcttcacttttcgaggccagattt

SEQ ID NO: 1210 - protein, 477 aa, Zea mays
  GRMZM2G076657_T02 polypeptide
MSARPPPPPRPRLALPPRSTAESLFTGAGDASPGPLTLASALFPSDADGGGGPGGASSSAAGAATFTQLLTGSLAPPPQQQQHEAQTGGGGVARAGPALSVAPPASSFAGASLFTVPPGLSPSGLLDSPGLLFSPAMGGFGMSHQQALAQVTAQATHSPLRMFDHLEQPSFSTAATTSGALHHMNSAASMAGISDMTMATANNENPSFQSAEASQRYQVNAPVDKPADDGYNWRKYGQKVVKGSDCPRSYYKCTHPNCPVKKKVEHAEDGQISEIIYKGKHNHQRPPNKRAKDGNSSAFDQNEQSNDTTSGLSGAKRDQDNIYGMSEQAYGLSDGDDMDDGESRPHEVDDADNESKRRNIQISSQRTLSESKIIVQTTSEVDLLDDGYRWRKYGQKVVKGNSHPRSYYKCTFAGCNVRKHIERASSDPRAVITTYEGKHDHEPPVGRGNNQNAGIPQQKEGQNNISSNQASLFEARF

SEQ ID NO: 1211 - DNA, 1488 bp, Zea mays
  GRMZM2G143765_T01
atgtccgcgcgtccgccgcctcaaccgcgaccgcgcctggcgctgccgccgcgctcgacggcggaatcgctcttcacgggcgccggggacaccagccccggcccgctcacgctcgcctcagcgctcttcccctctgacgccgacggcggcggtggccccggaggcgcgtcctcctccgccgccggggccgcgaccttcacgcagctcctcaccggctcccttgcgcctcctcctcctccgcagcagcggcatgacgcggagaggggacgaggcggcggggtcgccagggccgggccggcgctctcggtggcgccgccggcatcggcgtccgctggcgcgtccgtgttcacggtgccgcccggcctcagcccctccggtttgttcgactcccctgggctgctcttctcgcccgccatgggcggttttggaatgtcgcaccagcaggctttggctcaagttacagcccaagcaacccattctccactcagaatgtttgatcaccttgaacagccatctttctccacagctgcaacaatgtctggagctctacagcacatgaattctgcagccagtatggcaggaatttcagatatgacaatggcaacagcaaacaatgagaacacgtcctttcagtctgctgaggcgtctcagaggtatcaagttaatgcccctgttgataagcctgctgatgatggctataactggcggaaatatggtcagaaggtggtaaagggcagtgattgtccaaggagctactacaaatgcactcatcccaattgcccggtcaagaaaaaggtagagcatgcagaggatggtcagatatctgagatcatatacaaaggcaaacacaatcaccaacgtccaccaaataagcgggcaaaagacggcaactcttcagcagctgatcacaatgaacaatctaatgataccgcatctggcttgtcagctgccaagagagatcaggacaatatatatgggatgtctgagcaagcatctggtttaagtgacggagatgatatggatgatggtgaatcaaggccacatgaagtggatgacgctgataatgagagcaaaagaaggaatatacacatttcttcacaaaggaccttgtcagagcctaagattattgtgcaaacaaccagtgaggttgatcttctggatgatggttatagatggcgcaagtatgggcagaaggtagtcaaagggaatccacatccaaggagctactacaagtgcacgtttgctggatgcaatgttaggaagcacattgagaggtgttcatcagaccctaaggctgtcataacaacctatgaaggaaaacataaccatgaaccaccggttggtcggggcggcaaccagaacgcaggaatgtcatcacaacagaaagggcagaacaacgtatccagcaatcaagcttcattctcgagaccagacttgagcaacgctaaccagatgccaattggaatcttacagttcaagagcgagcaa

SEQ ID NO: 1212 - protein, 496 aa, Zea mays
  GRMZM2G143765_T01 polypeptide
MSARPPPQPRPRLALPPRSTAESLFTGAGDTSPGPLTLASALFPSDADGGGGPGGASSSAAGAATFTQLLTGSLAPPPPPQQRHDAERGRGGGVARAGPALSVAPPASASAGASVFTVPPGLSPSGLFDSPGLLFSPAMGGFGMSHQQALAQVTAQATHSPLRMFDHLEQPSFSTAATMSGALQHMNSAASMAGISDMTMATANNENTSFQSAEASQRYQVNAPVDKPADDGYNWRKYGQKVVKGSDCPRSYYKCTHPNCPVKKKVEHAEDGQISEIIYKGKHNHQRPPNKRAKDGNSSAADHNEQSNDTASGLSAAKRDQDNIYGMSEQASGLSDGDDMDDGESRPHEVDDADNESKRRNIHISSQRTLSEPKIIVQTTSEVDLLDDGYRWRKYGQKVVKGNPHPRSYYKCTFAGCNVRKHIERCSSDPKAVITTYEGKHNHEPPVGRGGNQNAGMSSQQKGQNNVSSNQASFSRPDLSNANQMPIGILQFKSEQ

SEQ ID NO: 1213 - DNA, 1503 bp, Setaria italica
  Si035317m
atggcggcccacgaggcctccgcctccgcccccgccgcgggcgacggggctgcgcgccgcccgccgcggcccacgctcgcgctgcccccgcgctccgccgtcgagtccctcttcgccggcgccggcggctcctcctcctcggccggcgccgccgagacaagccccggcccgctcaccctcgccgccgcgctcttcccggacgcgccctccccggccttccacggctccttcacccagctcctcgtcggcgccataggctcgccggccgccgccgccgccgcggccgtccccacgccgccgtccccgttctccgtgccgccggggctcagccccaccgcgctcctcggctcgccgggcctcttctccccgacggggagttttgagatgtcccatcagcaagccttggcacaagtaacagcacaagcagtccactctcagtacaatatgatcaataactcagattactcgatccctttttcatcgacaacaaaaccagctgccaatgtgaaattacagcatgtcaaccctgccaatgtgacatcaacgcaggagatatcaactctgccgtcacatactggtaacaacaacattgaacctaatgaggtttcacaaggactccagaattctgcacccacttttgataaacctgctgacgatggatacaactggcggaagtatggccagaaggcggttaagggtggggagtatccaaggagttactacaaatgtacccatgcgagttgtccagttaagaaaaaagtggagcgctcaggagaaggacacatcactcaaataatttatagaggtcagcacaaccaccagcgtccaccgaaaaggaggtccaaagatggtggtggtctactaaatgaagcagatgatttccatgagaatgaagatgcttcaactagatcagaaccaggctctcaagatcactctggaaaacatggggggtcaaatgatggcttagcagggccttcagtgtcaaggaggagagaaggagatgaacaattgtcgggctcaagtgatagtgaggaagaggcagatgatgaacagagggtaggtaatggagatgctggtcgtgcaaatgcaaacagaagacatgtgccgactccagctcgaaggataattgtgcaaacaactagtgaggttgatcttttagatgatggttaccgatggcgcaagtatggacagaaagtagtaaaagggaatccacacccgaggagttactacaaatgcacgtaccaagggtgtgacgtgaagaagcatatcgaaaggtcatcacaagacccaaaggctgttataacgacatacgaagggaagcacagccatgatgtgccagcagccaggaacagcagccatgctgctgctgctgctgctaacgctaacgcgtcatcctccagcagcttaccacacaagggccagaattcagcatccagtagtcgcaaaagagcagacatgtcatcggcttcttctatgctactaaaagaggaaaatgaaataaca

SEQ ID NO: 1214 - protein, 501 aa, Setaria italica
  Si035317m polypeptide
MAAHEASASAPAAGDGAARRPPRPTLALPPRSAVESLFAGAGGSSSSAGAAETSPGPLTLAAALFPDAPSPAFHGSFTQLLVGAIGSPAAAAAAAVPTPPSPFSVPPGLSPTALLGSPGLFSPTGSFEMSHQQALAQVTAQAVHSQYNMINNSDYSIPFSSTTKPAANVKLQHVNPANVTSTQEISTLPSHTGNNNIEPNEVSQGLQNSAPTFDKPADDGYNWRKYGQKAVKGGEYPRSYYKCTHASCPVKKKVERSGEGHITQIIYRGQHNHQRPPKRRSKDGGGLLNEADDFHENEDASTRSEPGSQDHSGKHGGSNDGLAGPSVSRRREGDEQLSGSSDSEEEADDEQRVGNGDAGRANANRRHVPTPARRIIVQTTSEVDLLDDGYRWRKYGQKVVKGNPHPRSYYKCTYQGCDVKKHIERSSQDPKAVITTYEGKHSHDVPAARNSSHAAAAAANANASSSSSLPHKGQNSASSSRKRADMSSASSMLLKEENEIT

SEQ ID NO: 1215 - DNA, 1482 bp, Setaria italica
  Si021859m
atgtccgctcgccccccgccgccgccgcgcccgcacctggcgctgccgccgcgctcggcggcggagtcgctcttcacgggcgccggcgacgccagccccggcccgctcacgctcgcctccgcgctcttcccctccgacgccgacgccggcggcggaggcggacccggcggcggcgcctcctccggggccgcgagcttcacgcagctcctcaccggctccctcccgcagccgcagcagcagcagcgtgaggccgcggagagggggcggggtggcggggtcgcgagggccgggccggcgctgtcggtggcgccgccggcgtcggcgtccgcgggcgcgtccgtcttcacggtgcccccaggcctcagcccctccggcctgctcgactcccccggcctgctcttctcgccggccatggggggatttggaatgtcgcaccagcaggcccttgctcaagttacagcacaagcaacccattctccacttagaatgtttgaccacattgagcaaccatctttttcagcagctgcagcatcgtctggagctctacaacatatgaactctagcgccaatatgactggaatgccagagatggcaattacaacagcaaacaatgacaatgcatcttttcaatcagctgagccatctcagaggtatcaagtcaatgctcctgttgataagcctgctgatgatggctacaactggcggaaatatggtcaaaaggtggtgaagggcagtgattgcccaaggagctattacaaatgtactcatcccaattgtccagtcaagaaaaaggtagagcatgcagaagatggtcaaatatctgagatcatatacaaaggaaaacacaatcaccaacgtccaccaaataagcgggcaaaagatggcaactcttcagcagctgatcaaaatgaacaatctaatgataccacttctggattgtcaggcgccaagagagatcaggacgctatatatgggatgtctgaacaggtatctggtttaagtgatggagatgatatggatgatggtgaatcaaggccacatgaagtggacgacgctgataatgagagcaaaagaagaaatatacaaatttcttcacaaagaaccttgtcggagcctaagattattgtgcaaacaactagtgaggttgatcttttggatgatggttatagatggcgcaagtatgggcagaaggtagtcaaaggaaaccctcatccaaggagttactacaagtgcacattcgctggatgcaatgttaggaagcacatcgaaagagcatcgtcagaccctaaggctgtcataacaacctatgaaggaaaacataaccatgaaccaccggttggtaggggcagcaaccagaatgcaggagtgtcacaacagagagggcagaacagcatatctagtaatcaagcttcactttcgatagcagactacagcatcactaaccagaggccaattgggctattacaattcaagagcgaacaa

SEQ ID NO: 1216 - protein, 494 aa, Setaria italica
  Si021859m polypeptide
MSARPPPPPRPHLALPPRSAAESLFTGAGDASPGPLTLASALFPSDADAGGGGGPGGGASSGAASFTQLLTGSLPQPQQQQREAAERGRGGGVARAGPALSVAPPASASAGASVFTVPPGLSPSGLLDSPGLLFSPAMGGFGMSHQQALAQVTAQATHSPLRMFDHIEQPSFSAAAASSGALQHMNSSANMTGMPEMAITTANNDNASFQSAEPSQRYQVNAPVDKPADDGYNWRKYGQKVVKGSDCPRSYYKCTHPNCPVKKKVEHAEDGQISEIIYKGKHNHQRPPNKRAKDGNSSAADQNEQSNDTTSGLSGAKRDQDAIYGMSEQVSGLSDGDDMDDGESRPHEVDDADNESKRRNIQISSQRTLSEPKIIVQTTSEVDLLDDGYRWRKYGQKVVKGNPHPRSYYKCTFAGCNVRKHIERASSDPKAVITTYEGKHNHEPPVGRGSNQNAGVSQQRGQNSISSNQASLSIADYSITNQRPIGLLQFKSEQ

SEQ ID NO: 1217 - DNA, 1239 bp, Brachypodium distachyon
  Bradi1g07970.1
atggcagatcggcgaggcgacgccatgaggcagcagcagcagccgttcgggtctggtcaggagagggtcttcgacggcggcggtggcggcggcccggcgttcggaggcgattatgatcatgcatcatcgtcctacatggcgcttcttggcaccggcgtcaacccccagcctctgccgccaccgccagcggcatgggcggttgaggaggtcacctcggcgaccgcgattaatctcacgccgcagttctccatggcaaactacgcgccgccgtcgtcgtcctcctaccaacaaaaccccgcctccttcgcctcacccttcgccgccgccgccctccacaacccctaccagccaccgtccacgacatacttcaaccacgccgacccgccgccgcaatggcctccgcgagcgccctcctcctccctgccgccgccccgcggcaacaacttcgcgctccagcacgagcagcagcagcagcagcagagcatgcagatgcagctgctgcgcgcgctggggcggccgcatcaagcgcttgcatcggctccggcggcggcggccatcgagcagccgggcaaggacgggtacaactggcgcaagtacgggcagaagcagctcaaggacgccgagtcgccgcggagctactacaagtgcacgcgggaggcgtgccccgtgaagaagatcgtggagcgctccttcgacggctgcatcaaggagatcacctacaagggccgccacacccacccgcggcccccccaccagccccgccgcggcggcgataatgtcgccgacgccggttccggcgccgacgccgaggaagaggaggaggaacacggggaccagctgccgagcgacgacgaggacaacggccaggagggccaggacaggactgcgggtggaggagcggcggcggggcagagggtggtgaagaagcacaagatcacactgcagacgcccagcgaagttgatctgctggacgacggctaccggtggcgcaagtacggccagaaagtggtcaagggaaacccccgtcccaggagctactacaagtgcacggcggagaactgcaacgtgcggaagcagatcgagcgggcgtccagcaatcccagctgcgtcctgacgacctacaccggccgccacagccaccacccgccggggagggccaccggcggctcttctgctgttccgacgccctccaccgccatcggcaatactgctcgtcagctcaaggaagagagccgggat

SEQ ID NO: 1218 - protein, 413 aa, Brachypodium distachyon
  Bradi1g07970.1 polypeptide
MADRRGDAMRQQQQPFGSGQERVFDGGGGGGPAFGGDYDHASSSYMALLGTGVNPQPLPPPPAAWAVEEVTSATAINLTPQFSMANYAPPSSSSYQQNPASFASPFAAAALHNPYQPPSTTYFNHADPPPQWPPRAPSSSLPPPRGNNFALQHEQQQQQQSMQMQLLRALGRPHQALASAPAAAAIEQPGKDGYNWRKYGQKQLKDAESPRSYYKCTREACPVKKIVERSFDGCIKEITYKGRHTHPRPPHQPRRGGDNVADAGSGADAEEEEEEHGDQLPSDDEDNGQEGQDRTAGGGAAAGQRVVKKHKITLQTPSEVDLLDDGYRWRKYGQKVVKGNPRPRSYYKCTAENCNVRKQIERASSNPSCVLTTYTGRHSHHPPGRATGGSSAVPTPSTAIGNTARQLKEESRD

SEQ ID NO: 1219 - DNA, 1341 bp, Brachypodium distachyon
  Bradi1g22680.1
atggcggccgagcagtggtcaggcggcggcggcgggctctgggcgccgccctctgccgccatggagagcctcttccccgacgagccggcgccggccgcggcggtcctgggaatcttcggcgcctggggcttgcaggcgcagctccattcccttccgccgctgtgcgccgccgcgctcctcgggtacccccaggacaatttcgatatgttccatgcacaggacctagcacagctagcagcacaagtggctcaaaaggcagagttggaggaaacacacagtggagaactaaatccaaagattacacctcaaatagcctatactaagtacagtatactcgatcaggcacataactcctctttctcgtcggcaacttcagcacagacatctcaacatgtcagttcttctgtaatcgcgccatccatgtggtgcataccgactttgccatcacatacagaatgtatcaagaccgaatcgaatagggtttcacaagtactccaaggtgcatccatcactcttgatagaccggctgatgatggctacaattggcgcaagtatgggcagaaggctgtgaaaggtgggaggtatccaaggagctattacaaatgtaccctgaactgtccggtcaggaaaaatgtggagcactctgaagatggaaaaataattaaaataatttatagaggtcagcacagtcatgaacgtccctcaaagaggtataaagattgtggtattttattaaaggagtcagatgatttcaatgacactgaggatgcttcaactaaatcacaattagactgtctcggttatgacggaaaacctgtaacatcaattggcaccatggcggactattcattaccaatgagggaagggggagatgagaaagtgtctggtacaagtgattaccggggagagggtgatgacgaaacacgaactgctgatgaagctgttggtgacaccgatgcgaatgaaaggaatgcaccaggtcaaaagattatcgtgagtacaacaagtgatgttgaccttttggacgatggctataggtggcgcaagtacggacagaaagtggtgagaggaaatcctcacccaaggagctattacaaatgcacttaccaaggctgtgatgtaaagaagcatattgagagatcttcccaggaaccacatgctgtgataactacatacgaagggaagcatgttcatgacgttcctgggtctaggaacagaagccatgctgcaggtcaaccctattgcacagaacagacttattcggagcaatcatctgctagcttctgcagtaggtctgaaaaaggaaaatacagtgcagtcagcctaaaacatgttgctttc

SEQ ID NO: 1220 - protein, 447 aa, Brachypodium distachyon
  Bradi1g22680.1 polypeptide
MAAEQWSGGGGGLWAPPSAAMESLFPDEPAPAAAVLGIFGAWGLQAQLHSLPPLCAAALLGYPQDNFDMFHAQDLAQLAAQVAQKAELEETHSGELNPKITPQIAYTKYSILDQAHNSSFSSATSAQTSQHVSSSVIAPSMWCIPTLPSHTECIKTESNRVSQVLQGASITLDRPADDGYNWRKYGQKAVKGGRYPRSYYKCTLNCPVRKNVEHSEDGKIIKIIYRGQHSHERPSKRYKDCGILLKESDDFNDTEDASTKSQLDCLGYDGKPVTSIGTMADYSLPMREGGDEKVSGTSDYRGEGDDETRTADEAVGDTDANERNAPGQKIIVSTTSDVDLLDDGYRWRKYGQKVVRGNPHPRSYYKCTYQGCDVKKHIERSSQEPHAVITTYEGKHVHDVPGSRNRSHAAGQPYCTEQTYSEQSSASFCSRSEKGKYSAVSLKHVAF

SEQ ID NO: 1221 - DNA, 1473 bp, Brachypodium distachyon
  Bradi1g16120.1
atggcggcacacgaggcctccgctagcggaggcgagggcgcgcgccgcccgccgccgcgtcccgcgctctccctgcccccgcgtgccgccgccgaatcctttttcgccgccgccggctccgctgccgagtcaagccccggccctctcaccctcgccgccgcgctcttccccgacatgccctccccggccttccacggctccttcacccagctcctcgtcggcgccatgggttccccagccgcatcctccgccagcggcccttcccctccctcgccgttccccgtgccaccggggctcagccgcaccgctctccttggctctccctcgcttttctcccctacggggaattttgaaatgtcccatcgacaagccttagcacaagtaacagcgcaagcagtccattctcagtacactattgttaatcaagcagactacccgctccctttctcgtcgacaacttcagctttcacatcacagcatgtaaactcttctgcaaacattacatcaacggaggagacaccaaccccaccatcacttacaggtaatagcaacttcaaaccaaatgaggtttcacaaggattccaaacatccgctctcactgtggataaacctgctgatgatggctacaattggcggaagtatggccagaaggcagttaaaggtggggagtatccaaggagctactataaatgcacccaggcgggctgtccagttaagaagaaagtggagcgctcagcatgtggagagattactcaaataatttatagaggacagcataaccaccaacgtccaccgaaaaggaggtctaaagatggtggtagtttactagatgaagtggatgatttccatgagaatggagacactttgaatagatcagagcaaggatctcaagaccactctgcaaaatttgaggtatcaaatgatggcatcacggttccttcaatgtctaagagggcagagggggatgatcaatcgtcaggctcaagtgatagtgaggagaaggcttgtgatgaagcaggggcggacaacggagatggtggttctacgaatgcaaagaagaggcatgttccagctccagctcaaaggatcattgtgcaaacaactagtgaggttgatcttttggatgatggctacaggtggcgcaagtatgggcagaaagtggtaaaagggaatcctcatccaaggagttactacaaatgcactttccaaggatgtgatgtaaagaagcatatcgaaagatgttcacaagactcgacggatgtgataactacatatgaaggcaagcacagccatgatgtaccagcagctaggaacagcagccatgcttctaatgccaatgcgtcatcttccagcagcttacggcacagagcgcagaatacggcatcaagtagccaaccatcgctgcgcagatcagcattacgtacagcttcgtcagattcttctctacagctaaaagaagaaaatgagataaca

SEQ ID NO: 1222 - protein, 491 aa, Brachypodium distachyon
  Bradi1g16120.1 polypeptide
MAAHEASASGGEGARRPPPRPALSLPPRAAAESFFAAAGSAAESSPGPLTLAAALFPDMPSPAFHGSFTQLLVGAMGSPAASSASGPSPPSPFPVPPGLSRTALLGSPSLFSPTGNFEMSHRQALAQVTAQAVHSQYTIVNQADYPLPFSSTTSAFTSQHVNSSANITSTEETPTPPSLTGNSNFKPNEVSQGFQTSALTVDKPADDGYNWRKYGQKAVKGGEYPRSYYKCTQAGCPVKKKVERSACGEITQIIYRGQHNHQRPPKRRSKDGGSLLDEVDDFHENGDTLNRSEQGSQDHSAKFEVSNDGITVPSMSKRAEGDDQSSGSSDSEEKACDEAGADNGDGGSTNAKKRHVPAPAQRIIVQTTSEVDLLDDGYRWRKYGQKVVKGNPHPRSYYKCTFQGCDVKKHIERCSQDSTDVITTYEGKHSHDVPAARNSSHASNANASSSSSLRHRAQNTASSSQPSLRRSALRTASSDSSLQLKEENEIT

SEQ ID NO: 1223 - DNA, 1503 bp, Brachypodium distachyon
  Bradi4g06690.1
atgtcgtcgcgcccgcccccgccgccgcgcccgcacctgtcgctgccgccgcgctcgaccgcggagtcgctcttcaccggcgtcggggacgctagccccggcccgctcacgctcgcttccgcgctcttctcctccgactccgacgccgacggcggcggaggcggcggcgggggcagcgcctcctctggctcggggccgacgagcttcacccagctgctcatcggcaacctctcgcagccgcctcagcaacaacagcagcagcagcagcagcagcaagagagggggagaggcggggtcgcgagggcagggccggcgatttctgtggcgccgccggcgggcgcggccgtgttcaccgtgccccccgggctgagcccttccggcttattcgactcacccggcctgatcttctcgccggccatgggaggttttggcatgtcacatcaacaggccctggcccaagttacagcccaagcaagccattctccgctcagaatgtttgatcacattgaacaaccatctttctcagcagctgcatcatcatctgaagctgtacaacatatgagctctgcagccaatatggcaggaatgtcagagatggcgacaatatcgaacaatgataatgcagcatttcattctgctgaggcgtcccagaggtaccaagttcctgcccctgttgataagcctgctgatgatggctacaattggcgaaaatatggtcagaaggtggtgaagggtagtgattgcccaaggagctactacaaatgtactcatcccagttgtcctgtcaagaaaaaagtagagcacgcagaagatggtcaaatatctgagatcatatacaaaggaaaacacaatcaccagcgaccaccaaataagcgggcaaaagatggcaactcttcagcagccgagcacaatgaacaatccaatgacacagcatctggtttgtcaggcgttagaagagatcaggaagctgtatatgcaatgtctgaacaattatcaggtttaagtgatggagatgataaggatgatggtgaatctaggccaaatgaagttgataatggagagaatgactgcaaacgaaggaatatacaagtttcttcgcagaagaccctgacagagtctaagatcatcgtgcaaacaaccagtgaggttgaccttttggatgatggttatagatggcgcaagtatgggcagaaggtggtcaaaggaaatcctcatccaaggagttactacaagtgcacgtttgctggttgcaatgttaggaagcacattgagagggcctcttcagatcccaaggctgtcataacaacttatgaaggaaaacataaccatgaaccaccagttggtaggggcagtaatcagaacgcaggaaactcagccccttccaacaggtcacagcagaaagggccgagtagcatgtccagtaatcaaacttcacttacaagaacagacttcagcaacaataaccagaggccaattggggtgttacagttcaagagggaagag

SEQ ID NO: 1224 - protein, 501 aa, Brachypodium distachyon
  Bradi4g06690.1 polypeptide
MSSRPPPPPRPHLSLPPRSTAESLFTGVGDASPGPLTLASALFSSDSDADGGGGGGGGSASSGSGPTSFTQLLIGNLSQPPQQQQQQQQQQQERGRGGVARAGPAISVAPPAGAAVFTVPPGLSPSGLFDSPGLIFSPAMGGFGMSHQQALAQVTAQASHSPLRMFDHIEQPSFSAAASSSEAVQHMSSAANMAGMSEMATISNNDNAAFHSAEASQRYQVPAPVDKPADDGYNWRKYGQKVVKGSDCPRSYYKCTHPSCPVKKKVEHAEDGQISEIIYKGKHNHQRPPNKRAKDGNSSAAEHNEQSNDTASGLSGVRRDQEAVYAMSEQLSGLSDGDDKDDGESRPNEVDNGENDCKRRNIQVSSQKTLTESKIIVQTTSEVDLLDDGYRWRKYGQKVVKGNPHPRSYYKCTFAGCNVRKHIERASSDPKAVITTYEGKHNHEPPVGRGSNQNAGNSAPSNRSQQKGPSSMSSNQTSLTRTDFSNNNQRPIGVLQFKREE

SEQ ID NO: 1225 - DNA, 1407 bp, Triticum aestivum
  ACD80362.1 (WRKY19)
atggcggcggggcagtggtcaggcatcggcgacggcggcggcctctgggccccgcccgcgctcgacagcctcttccccgacgaccagccgtcgccggccgcctcggcgctgggcttcttcggtggatccctcgcgcagctcccttcccctccgccgctctgcggcaccgcgctcctcgggtacccccaggacaactttgatgtgttccatgaacgagacctagcacagctggcagcacaagtggctcaaaagaaagagttgcgggaaaaacaaggggcgggattgcatcacaagattggacctcaactagctttttctaaatacagtatacttgatcaagtggacaactcctcttctttctcattggcaacttcagtgctgacacctcagcatgtcagttcttccgtaggcgcggcattaatgcagggacggactttgccatcacacactggtagtggtagtgtcaacactggaccaactggagttttacaagcgctccaagattcatccaccactctggacagtatcaacactggatcaactggagttctggaagcactccaaggttcatccatcactctggatagacctgctgatgatggatacaactggcgtaagtatggacaaaaggcagtcaagggtgggaagtatccaaggagctattacaaatgtaccctgaattgcccggccaggaaaaatgtagagcactctgcagatagacgaattattaaaataatttatagaggtcagcactgccatgaacccccctcaaagaggtttaaagattgtggtgatttattgaatgagttaaatgatttcgatgatgccaaggagccttcaactaaatcacaattaggttgtcaaggttattatggaaaacctataacgccaaatggaatgatgacggatgttttattgccaacgaaggaagagggggatgagcaattatctagtttaagtgatatccgggaaggtgatggtgaaataagaactgttgatggagatgatggtgatgccgatgcaaatgaaaggaatgcaccaggtcaaaagattatcgtgagtacaacgagcgatgctgatcttttggacgacggctataggtggcgcaagtatggacagaaagtggtgagaggaaatcctcacccaaggagctattacaagtgcacttaccaaggatgcgacgtcaagaagcatatcgagagatcttccgaggaaccacatgctgtgataactacatacgaagggaagcatacgcatgacgtgcctgagtctaggaacagaagccaagccacaggtcaacaccactgcaaagagcagacttattcagaacaatcagctgcaagcttctgcagtagctcggaaaagagaaaatatggaacagccattctgaacgatctcgccttctag

SEQ ID NO: 1226 - protein, 468 aa, Triticum aestivum
  ACD80362.1 (WRKY19) polypeptide
MAAGQWSGIGDGGGLWAPPALDSLFPDDQPSPAASALGFFGGSLAQLPSPPPLCGTALLGYPQDNFDVFHERDLAQLAAQVAQKKELREKQGAGLHHKIGPQLAFSKYSILDQVDNSSSFSLATSVLTPQHVSSSVGAALMQGRTLPSHTGSGSVNTGPTGVLQALQDSSTTLDSINTGSTGVLEALQGSSITLDRPADDGYNWRKYGQKAVKGGKYPRSYYKCTLNCPARKNVEHSADRRIIKIIYRGQHCHEPPSKRFKDCGDLLNELNDFDDAKEPSTKSQLGCQGYYGKPITPNGMMTDVLLPTKEEGDEQLSSLSDIREGDGEIRTVDGDDGDADANERNAPGQKIIVSTTSDADLLDDGYRWRKYGQKVVRGNPHPRSYYKCTYQGCDVKKHIERSSEEPHAVITTYEGKHTHDVPESRNRSQATGQHHCKEQTYSEQSAASFCSSSEKRKYGTAILNDLAF

SEQ ID NO: 1227 - protein, 57 aa, Arabidopsis thaliana
  AT2G03340.1 first WRKY domain
ADDGYNWRKYGQKQVKGSDFPRSYYKCTHPACPVKKKVERSLDGQVTEIIYKGQHNH

SEQ ID NO: 1228 - protein, 58 aa, Arabidopsis thaliana
  AT2G03340.1 second WRKY domain
LDDGYRWRKYGQKVVKGNPYPRSYYKCTTPDCGVRKHVERAATDPKAVVTTYEGKHNH

SEQ ID NO: 1229 - protein, 57 aa, Arabidopsis thaliana
  AT1G13960.1 first WRKY domain
ADDGYNWRKYGQKQVKGSEFPRSYYKCTNPGCPVKKKVERSLDGQVTEIIYKGQHNH

SEQ ID NO: 1230 - protein, 58 aa, Arabidopsis thaliana
  AT1G13960.1 second WRKY domain
LDDGYRWRKYGQKVVKGNPYPRSYYKCTTPGCGVRKHVERAATDPKAVVTTYEGKHNH

SEQ ID NO: 1231 - protein, 57 aa, Glycine max
  Glyma01g06550.1 first WRKY domain
ADDGYNWRKYGQKQVKGSEFPRSYYKCTHPNCSVKKKVERSLEGHVTAIIYKGEHNH

SEQ ID NO: 1232 - protein, 58 aa, Glycine max
  Glyma01g06550.1 second WRKY domain
LDDGYRWRKYGQKVVKGNPYPRSYYKCTTQGCNVRKHVERASTDPKAVITTYEGKHNH

SEQ ID NO: 1233 - protein, 57 aa, Glycine max
  Glyma02g12490.1 first WRKY domain
ADDGYNWRKYGQKQVKGSEFPRSYYKCTNPNCPVKKKVERSLEGHVTAIIYKGEHNH

SEQ ID NO: 1234 - protein, 58 aa, Glycine max; identical to SEQ ID NO: 1232
  Glyma02g12490.1 second WRKY domain

SEQ ID NO: 1235 - protein, 57 aa, Glycine max
  Glyma07g35380.1 first WRKY domain
NDDGYNWRKYGQKHVKGRDFSRSYYKCTHPNCPVKKKLERSLEGHVTAIIYKGEHNH

SEQ ID NO: 1236 - protein, 58 aa, Glycine max
  Glyma07g35380.1 second WRKY domain
LDDGYRWRKYGQKVVKGNPYPRSYYKCATQGCNVRKHVERASMDPKAVLTTYEGKHNH

SEQ ID NO: 1237 - protein, 57 aa, Glycine max
  Glyma20g03410.1 first WRKY domain
NNDGYNWRKYGQKHVKGSDFSRSYYKCTRPNCPVKKKLERSLEGHVTAIIYKGEHNH

SEQ ID NO: 1238 - protein, 58 aa, Glycine max
  Glyma20g03410.1 second WRKY domain
LDDGYRWRKYGQKVVKGNPYPRSYYKCTTQGCKVRKHVERASMDPKAVITTYEGKHNH

SEQ ID NO: 1239 - protein, 57 aa, Glycine max
  Glyma08g26230.1 first WRKY domain
ADDGYNWRKYGQKQVKGSEYPRSYYKCTHLNCVVKKKVERAPDGHITEIIYKGQHNH

SEQ ID NO: 1240 - protein, 58 aa, Glycine max
  Glyma08g26230.1 second WRKY domain
LDDGYRWRKYGQKVVKGNPHPRSYYKCTSAGCNVRKHVERASMDPKAVITTYEGKHNH

SEQ ID NO: 1241 - protein, 57 aa, Glycine max; identical to SEQ ID NO: 1239
  Glyma18g49830.1 first WRKY domain

SEQ ID NO: 1242 - protein, 58 aa, Glycine max
  Glyma18g49830.1 second WRKY domain
LDDGYRWRKYGQKVVKGNPHPRSYYKCTSAGCNVRKHVERASTDPKAVITTYEGKHNH

SEQ ID NO: 1243 - protein, 57 aa, Vitis vinifera
  GSVIVT01001332001 first WRKY domain
ADDGYNWRKYGQKQVKGSEYPRSYYKCTHPSCPVKKKVERSLDGQVTEIIYKGQHNH

SEQ ID NO: 1244 - protein, 59 aa, Vitis vinifera
  GSVIVT01001332001 second WRKY domain
LLDDGYRWRKYGQKVVKGNPYPRSYYKCTNPGCNVRKHVERAATDPKAVITTYEGKHNH

SEQ ID NO: 1245 - protein, 57 aa, Solanum lycopersicum
  Solyc05g012770.2.1 first WRKY domain
ADDGYNWRKYGQKQVKGSEYPRSYYKCTNPNCPVKKKVERSLDGQVTEIIYKGQHNH

SEQ ID NO: 1246 - protein, 58 aa, Solanum lycopersicum
  Solyc05g012770.2.1 second WRKY domain
LDDGYRWRKYGQKVVKGNPYPRSYYKCTSQGCNVRKHVERAASDPKAVITTYEGKHNH

SEQ ID NO: 1247 - protein, 57 aa, Solanum lycopersicum
  Solyc02g088340.2.1 first WRKY domain
ACDGYNWRKYGQKKVKASECPRSYYKCTYLKCLVKKKVERSVDGHITEITYNGRHNH

SEQ ID NO: 1248 - protein, 58 aa, Solanum lycopersicum
  Solyc02g088340.2.1 second WRKY domain
LDDGYKWRKYGQKVVKGTQHPRSYYRCTYPGCNVRKQVERASTDPKAVITTYEGKHNH

SEQ ID NO: 1249 - protein, 57 aa, Solanum lycopersicum
  Solyc03g104810.2.1 first WRKY domain
ASDGYNWRKYGQKMVKASECPRSYYKCTHLKCLVKKKVERSIDGHITEITYKGHHNH

SEQ ID NO: 1250 - protein, 58 aa, Solanum lycopersicum
  Solyc03g104810.2.1 second WRKY domain
LDDGFKWRKYGQKMVKGNHHPRSYYRCTYPGCNVRKHVERASADPKAVITTYEGKHNH

SEQ ID NO: 1251 - protein, 57 aa, Eucalyptus grandis
  Eucgr.B03189.1 first WRKY domain
ADDGYNWRKYGQKQVKGSEFPRSYYKCTHPDCPVRKKVERSLDGHITEIIYKGQHNH

SEQ ID NO: 1252 - protein, 58 aa, Eucalyptus grandis
  Eucgr.B03189.1 second domain
LDDGYRWRKYGQKVVKGNPYPRSYYKCTTPGCNVRKHVERASTDPKAVITTYEGKHNH

SEQ ID NO: 1253 - protein, 57 aa, Eucalyptus grandis
  Eucgr.G02469.1 first WRKY domain
ADDGYNWRKYGQKQVKGSEFPRSYYKCTHPTCPVKKKVERSLDGQITEIIYKGQHNH

SEQ ID NO: 1254 - protein, 58 aa, Eucalyptus grandis
  Eucgr.G02469.1 second WRKY domain
LDDGYRWRKYGQKLVKGNPYPRSYYKCTTTGCNVRKHVERASSDPKAVITTYEGKHNH

SEQ ID NO: 1255 - protein, 57 aa, Eucalyptus grandis
  Eucgr.I01998.1 first WRKY domain
TEDGYNWRKYGQKQVKGCGFPRSYYKCSHLNCSVKKKVEHSLDGRITEITYRGQHQH

SEQ ID NO: 1256 - protein, 58 aa, Eucalyptus grandis
  Eucgr.I01998.1 second WRKY domain
LDDGFKWRKYGQKVVKGSSYPRSYYKCTYAGCNVRKHIERAALDPKSVITTYEGKHNH

SEQ ID NO: 1257 - protein, 57 aa, Populus trichocarpa
  POPTR_0004s12000.1 first WRKY domain
TDDGYNWRKYGQKPIKGSEYPRSYYKCTHLNCLVKKKVERSSDGQITEIIYKGQHNH

SEQ ID NO: 1258 - protein, 58 aa, Populus trichocarpa
  POPTR_0004s12000.1 second WRKY domain
LDDGYRWRKYGQKVVKGNPHPRSYYKCTSAGCNVRKHVERAAADPKAVITTYEGKHNH

SEQ ID NO: 1259 - protein, 57 aa, Populus trichocarpa
  POPTR_0017s12430.1 first WRKY domain
THDGYNWRKYGQKPIKGSEYPRSYYKCTHLNCPVKKKVERSSDGQITEIIYKGQHNH

SEQ ID NO: 1260 - protein, 58 aa, Populus trichocarpa
  POPTR_0017s12430.1 second WRKY domain
LDDGYRWRKYGQKVVKGNPHPRSYYKCTSAGCNVRKHVERAAADPKAVVTTYEGKHNH

SEQ ID NO: 1261 - protein, 57 aa, Populus trichocarpa
  POPTR_0008s09140.1 first WRKY domain
TDDGYNWRKYGQKQVKGSEFPRSYYKCTHPNCPVKKKVERSLDGQVTEIIYKGQHNH

SEQ ID NO: 1262 - protein, 58 aa, Populus trichocarpa
  POPTR_0008s09140.1 second WRKY domain
LDDGYRWRKYGQKVVKGNPYPRSYYKCTTPGCKVRKHVERAAADPRAVITAYEGKHNH

SEQ ID NO: 1263 - protein, 57 aa, Populus trichocarpa
  POPTR_0010s17040.1 first WRKY domain
ANDGYNWRKYGQKQVKGSEYPRSYYKCTHPNCPVKKKVERSLDGQVTEIIYKGQHNH

SEQ ID NO: 1264 - protein, 58 aa, Populus trichocarpa
  POPTR_0010s17040.1 second WRKY domain
LDDGYRWRKYGQKVVKGNPYPRSYYKCTTAGCKVRKHVERAAADPKAVITTYEGKHNH

SEQ ID NO: 1265 - protein, 57 aa, Citrus clementina
  clementine0.9_006505m first WRKY domain
ADDGYNWRKYGQKPIKGNEYPRSYYKCTHVNCPVKKKVERSSSAQITQIIYKNEHNH

SEQ ID NO: 1266 - protein, 58 aa, Citrus clementina
  clementine0.9_006505m second WRKY domain
LDDGYRWRKYGQKVVKGNPHPRSYYKCTNPGCNVRKHVERAPTDPKAVVTTYEGKHNH

SEQ ID NO: 1267 - protein, 57 aa, Citrus clementina
  clementine0.9_007348m first WRKY domain
ADDPYNWRKYGQKHVKGSEFPRSYYKCTHPNCPVKKKVERSLDGQVTEIIYKGQHNH

SEQ ID NO: 1268 - protein, 58 aa, Citrus clementina
  clementine0.9_007348m second WRKY domain
LDDGYRWRKYGQKVVKGNPYPRSYYKCTTTGCNVRKHVERASTDPKAVITTYEGKHNH

SEQ ID NO: 1269 - protein, 57 aa, Oryza sativa
  LOC_Os07g40570.1 first WRKY domain
TDDGYNWRKYGQKAVKGGEYPKSYYKCTHLNCLVRKNVEHSADGRIVQIIYRGQHTH

SEQ ID NO: 1270 - protein, 58 aa, Oryza sativa
  LOC_Os07g40570.1 second WRKY domain
LDDGYRWRKYGQKVVKGNPYPRSYYKCTYLGCDVKKQVERSVEEPNAVITTYEGKHIH

SEQ ID NO: 1271 - protein, 57 aa, Oryza sativa
  LOC_Os03g33012.1 first WRKY domain
ADDGYNWRKYGQKAVKGGEYPRSYYKCTHLSCPVKKKVERSSDGQITQILYRGQHNH

SEQ ID NO: 1272 - protein, 58 aa, Oryza sativa
  LOC_Os03g33012.1 second WRKY domain
LDDGYRWRKYGQKVVKGNPHPRSYYKCTYQGCDVKKHIERSSQDPKAVITTYEGKHSH

SEQ ID NO: 1273 - protein, 57 aa, Oryza sativa
  LOC_Os12g32250.1 first WRKY domain
ADDGYNWRKYGQKVVKGSDCPRSYYKCTHPNCPVKKKVEHAEDGQISEIIYKGKHNH

SEQ ID NO: 1274 - protein, 58 aa, Oryza sativa
  LOC_Os12g32250.1 second WRKY domain
LDDGYRWRKYGQKVVKGNPHPRSYYKCTYAGCNVRKHIERASSDPKAVITTYEGKHNH

SEQ ID NO: 1275 - protein, 57 aa, Zea mays
  GRMZM2G008029_T01 first WRKY domain
AKDGYTWRKYGQKQLKDAESPRSYYKCTRDGCPVKKVVERSFDGLIKEITYKGRHNH

SEQ ID NO: 1276 - protein, 58 aa, Zea mays
  GRMZM2G008029_T01 second WRKY domain
LDDGYRWRKYGQKVVKGNPRPRSYYKCTADNCNVRKQIERATTDPRCVLTTYTGRHNH

SEQ ID NO: 1277 - protein, 57 aa, Zea mays
  GRMZM2G171428_T01 first WRKY domain
ADDGYNWRKYGQKAVKGGEYPRSYYKCTHTSCPVKKKVERSAEGHITQIIYRGQHNH

SEQ ID NO: 1278 - protein, 58 aa, Zea mays
  GRMZM2G171428_T01 second WRKY domain
LDDGYRWRKYGQKVVKGNPYPRSYYRCTYQGCDVKKHIERSSQDPKAVITTYEGKHSH

SEQ ID NO: 1279 - protein, 57 aa, Zea mays; identical to SEQ ID NO: 1273
  GRMZM2G076657_T01 first WRKY domain

SEQ ID NO: 1280 - protein, 58 aa, Zea mays
  GRMZM2G076657_T01 second WRKY domain
LDDGYRWRKYGQKVVKGNSHPRSYYKCTFAGCNVRKHIERASSDPRAVITTYEGKHDH

SEQ ID NO: 1281 - protein, 57 aa, Zea mays; identical to SEQ ID NO: 1273
  GRMZM2G076657_T02 first WRKY domain

SEQ ID NO: 1282 - protein, 58 aa, Zea mays; identical to SEQ ID NO: 1280
  GRMZM2G076657_T02 second WRKY domain

SEQ ID NO: 1283 - protein, 57 aa, Zea mays; identical to SEQ ID NO: 1273
  GRMZM2G143765_T01 first WRKY domain

SEQ ID NO: 1284 - protein, 58 aa, Zea mays
  GRMZM2G143765_T01 second WRKY domain
LDDGYRWRKYGQKVVKGNPHPRSYYKCTFAGCNVRKHIERCSSDPKAVITTYEGKHNH

SEQ ID NO: 1285 - protein, 57 aa, Setaria italica
  Si035317m first WRKY domain
ADDGYNWRKYGQKAVKGGEYPRSYYKCTHASCPVKKKVERSGEGHITQIIYRGQHNH

SEQ ID NO: 1286 - protein, 58 aa, Setaria italica; identical to SEQ ID NO: 1272
  Si035317m second domain

SEQ ID NO: 1287 - protein, 57 aa, Setaria italica; identical to SEQ ID NO: 1273
  Si021859m first WRKY domain

SEQ ID NO: 1288 - protein, 58 aa, Setaria italica
  Si021859m second domain
LDDGYRWRKYGQKVVKGNPHPRSYYKCTFAGCNVRKHIERASSDPKAVITTYEGKHNH

SEQ ID NO: 1289 - protein, 57 aa, Brachypodium distachyon
  Bradi1g07970.1 first WRKY domain
GKDGYNWRKYGQKQLKDAESPRSYYKCTREACPVKKIVERSFDGCIKEITYKGRHTH

SEQ ID NO: 1290 - protein, 58 aa, Brachypodium distachyon
  Bradi1g07970.1 second WRKY domain
LDDGYRWRKYGQKVVKGNPRPRSYYKCTAENCNVRKQIERASSNPSCVLTTYTGRHSH

SEQ ID NO: 1291 - protein, 56 aa, Brachypodium distachyon
  Bradi1g22680.1 first WRKY domain
ADDGYNWRKYGQKAVKGGRYPRSYYKCTLNCPVRKNVEHSEDGKIIKIIYRGQHSH

SEQ ID NO: 1292 - protein, 58 aa, Brachypodium distachyon
  Bradi1g22680.1 second WRKY domain
LDDGYRWRKYGQKVVRGNPHPRSYYKCTYQGCDVKKHIERSSQEPHAVITTYEGKHVH

SEQ ID NO: 1293 - protein, 57 aa, Brachypodium distachyon
  Bradi1g16120.1 first WRKY domain
ADDGYNWRKYGQKAVKGGEYPRSYYKCTQAGCPVKKKVERSACGEITQIIYRGQHNH

SEQ ID NO: 1294 - protein, 58 aa, Brachypodium distachyon
  Bradi1g16120.1 second WRKY domain
LDDGYRWRKYGQKVVKGNPHPRSYYKCTFQGCDVKKHIERCSQDSTDVITTYEGKHSH

SEQ ID NO: 1295 - protein, 57 aa, Brachypodium distachyon
  Bradi4g06690.1 first WRKY domain
ADDGYNWRKYGQKVVKGSDCPRSYYKCTHPSCPVKKKVEHAEDGQISEIIYKGKHNH

SEQ ID NO: 1296 - protein, 58 aa, Brachypodium distachyon; identical to SEQ ID NO: 1288
  Bradi4g06690.1 second WRKY domain

SEQ ID NO: 1297 - protein, 56 aa, Triticum aestivum
  ACD80362.1 (WRKY19) first WRKY domain
ADDGYNWRKYGQKAVKGGKYPRSYYKCTLNCPARKNVEHSADRRIIKIIYRGQHCH

SEQ ID NO: 1298 - protein, 58 aa, Triticum aestivum
  ACD80362.1 (WRKY19) second WRKY domain
LDDGYRWRKYGQKVVRGNPHPRSYYKCTYQGCDVKKHIERSSEEPHAVITTYEGKHTH

SEQ ID NO: 1299 - protein, 59 aa, Arabidopsis thaliana
  WRKY3 clade first consensus polypeptide
  misc_feature (1)..(1): Xaa can be any naturally occurring amino acid
  misc_feature (3)..(4): Xaa can be any naturally occurring amino acid
  misc_feature (8)..(8): Xaa can be any naturally occurring amino acid
  misc_feature (16)..(17): Xaa can be any naturally occurring amino acid
  misc_feature (19)..(24): Xaa can be any naturally occurring amino acid
  misc_feature (27)..(27): Xaa can be any naturally occurring amino acid
  misc_feature (31)..(33): Xaa can be any naturally occurring amino acid
  misc_feature (35)..(35): Xaa can be any naturally occurring amino acid
  misc_feature (37)..(37): Xaa can be any naturally occurring amino acid
  misc_feature (39)..(40): Xaa can be any naturally occurring amino acid
  misc_feature (42)..(45): Xaa can be any naturally occurring amino acid
  misc_feature (47)..(50): Xaa can be any naturally occurring amino acid
  misc_feature (52)..(52): Xaa can be any naturally occurring amino acid
  misc_feature (54)..(54): Xaa can be any naturally occurring amino acid
  misc_feature (56)..(56): Xaa can be any naturally occurring amino acid
  misc_feature (58)..(58): Xaa can be any naturally occurring amino acid
XPXXDGYXWRKYGQKXXKXXXXXXSYXKCTXXXCXVXKXXEXXXXGXXXXIXYXGXHXH

SEQ ID NO: 1300 - protein, 74 aa, Arabidopsis thaliana
  WRKY3 clade second consensus polypeptide
  misc_feature (1)..(5): Xaa can be any naturally occurring amino acid
  misc_feature (7)..(7): Xaa can be any naturally occurring amino acid
  misc_feature (9)..(12): Xaa can be any naturally occurring amino acid
  misc_feature (17)..(18): Xaa can be any naturally occurring amino acid
  misc_feature (26)..(26): Xaa can be any naturally occurring amino acid
  misc_feature (28)..(28): Xaa can be any naturally occurring amino acid
  misc_feature (31)..(32): Xaa can be any naturally occurring amino acid
  misc_feature (38)..(38): Xaa can be any naturally occurring amino acid
  misc_feature (40)..(41): Xaa can be any naturally occurring amino acid
  misc_feature (43)..(43): Xaa can be any naturally occurring amino acid
  misc_feature (45)..(45): Xaa can be any naturally occurring amino acid
  misc_feature (47)..(48): Xaa can be any naturally occurring amino acid
  misc_feature (53)..(57): Xaa can be any naturally occurring amino acid
  misc_feature (59)..(59): Xaa can be any naturally occurring amino acid
  misc_feature (61)..(61): Xaa can be any naturally occurring amino acid
  misc_feature (63)..(63): Xaa can be any naturally occurring amino acid
  misc_feature (65)..(65): Xaa can be any naturally occurring amino acid
  misc_feature (67)..(67): Xaa can be any naturally occurring amino acid
  misc_feature (69)..(69): Xaa can be any naturally occurring amino acid
  misc_feature (71)..(73): Xaa can be any naturally occurring amino acid
XXXXXTXSXXXXLDDGXXWRKYGQKXVXGNXXPRSYYXCXXLXCXVXXQVERXXXXXNXVXTXYXGXHXHXXXP

SEQ ID NO: 1301 - DNA, 2070 bp, Brachypodium distachyon
  Bradi4g33370.1
atggctggcaccagtgaccgaggatccatcatggaggactggatggccatgcccccaactcccagtccgagaacactcatgtcaagcttcttgaatgaagacttcagctctggcccattctccaatttattcagtgaaaatggtagcaataagccccatgatcattcagagaagagaggagagtttgtggatttgagggaccaagtgcctgctcaatcagctgaagctacacttcaaaaggatatttccttggaaccaaacttgttcaatgctaatcagaaaccaaacccacatggcggtctggcagagcgcatggcttccagagctggtttcagcattccgaagatagatacatctcgtgttggttcatccacagttattcgatcacccatagcaattccacctggccttagtccaactactcttcttgagtcgccggtttttctttacaattctatggcgcagccttctccaactactgggaaattgccctttccggctacaaatgctaactcaacaataccaccagctgccaggatgaatgaagatcatacattcagtaatgatgttttttccttccaacctcacttaggttcgaaagcgccaagtttatcaacagtggaaaagggttacaatgcttgtccctcaaaccagtcattgtcaaatattcatcagcgggaatccaatttgcagtcaagctttactgcagtcaaggacactgcggatgaaacaattattaaaccgaagacatctgactccatgttcggtgatgatcactcatcttctgaagaacaggaagatgatgagacagatcaaaatggagaatattcttctgccacaattagcaccccagatgaggatggatataactggaaaaaatatggaccgaagcaagttaagagtaccgagtatccaaggagctactttaaatgcacacacccaaattgccctgtcaagaaaaaagtggagcgttctcaggttggtcagataacagagataatctacaagggtactcacaatcaccctttgccgcctctaaacccccactcaggtgtccctttgtcgcacatcagtgatccacaagtcaatgcccggaagaaccctggtttgcaggcagggctcgactctgcatctttgtgggaaaatggtagaagtggatgtatccaagatgtgcaaagtgaaggtgttgatgcaagacctggtactcgccttcctgtatcagcatatggtgatacatctatcgtggagtctcaagatgcagtcgatgtctcatcaacactgtctaatgaggagattgacagggcaacacatggcaccgtatctttagactgtgatggcggtgaagatgagactgaatctaaaagaaggaagctggatgctttggctactgctactgttactgccgccgccgccacctccaccaccagcacaattgacatggtggctgcggcatctagatctgtccgggagcctcgtgttgttgttcagacaaccagtgaggttgacatccttgatgacgggtatcgttggcgcaagtatggtcagaaggttgtcaaaggaaatccaaatccaaggagttactacaaatgcacgcaccctggctgttcagtgcgcaagcacgtggaaagagcatcgcatgatctgaaatctgtgatcacaacatatgagggaaagcacaaccatgaagttccagcagcgagaaatagcgggcatgcgagctctggttctggcagtgctccagcatctatgccgcaggttaatctctcccatcgtcggcaagaacaagcacaaggcagctttggtcagtttggtggttcaactcctttcggttcctttggtctcccaccaagaggccagttgggagcggcaggcaatttccgcttcgggatggttcctccaggcatgtcgattccaatgcccgctgctcatcagcaatcaatgatgcagggctacccagggctcatgatgccagaaggacagccgaagacggagccagggccacaatcagaacatgcagcctcatcagcttaccagcaaatgatgagcaggcccccctttggttctcagatg

SEQ ID NO: 1302 - protein, 690 aa, Brachypodium distachyon
  Bradi4g33370.1 polypeptide
MAGTSDRGSIMEDWMAMPPTPSPRTLMSSFLNEDFSSGPFSNLFSENGSNKPHDHSEKRGEFVDLRDQVPAQSAEATLQKDISLEPNLFNANQKPNPHGGLAERMASRAGFSIPKIDTSRVGSSTVIRSPIAIPPGLSPTTLLESPVFLYNSMAQPSPTTGKLPFPATNANSTIPPAARMNEDHTFSNDVFSFQPHLGSKAPSLSTVEKGYNACPSNQSLSNIHQRESNLQSSFTAVKDTADETIIKPKTSDSMFGDDHSSSEEQEDDETDQNGEYSSATISTPDEDGYNWKKYGPKQVKSTEYPRSYFKCTHPNCPVKKKVERSQVGQITEIIYKGTHNHPLPPLNPHSGVPLSHISDPQVNARKNPGLQAGLDSASLWENGRSGCIQDVQSEGVDARPGTRLPVSAYGDTSIVESQDAVDVSSTLSNEEIDRATHGTVSLDCDGGEDETESKRRKLDALATATVTAAAATSTTSTIDMVAAASRSVREPRVVVQTTSEVDILDDGYRWRKYGQKVVKGNPNPRSYYKCTHPGCSVRKHVERASHDLKSVITTYEGKHNHEVPAARNSGHASSGSGSAPASMPQVNLSHRRQEQAQGSFGQFGGSTPFGSFGLPPRGQLGAAGNFRFGMVPPGMSIPMPAAHQQSMMQGYPGLMMPEGQPKTEPGPQSEHAASSAYQQMMSRPPFGSQM

SEQ ID NO: 1303 - DNA, 1695 bp, Brachypodium distachyon
  Bradi3g39340.1
atgtccgggacgggcaagcgtggagcattgacggaggattggatgcttcccacacccagcccaagaactctcatgttaagcttgttcaacgaagatttgagctcaggtccatgctccgatgttttcggtgacaacaaaccccaggatggaatcgacggggccaaaccttctttagttgtttcgagctgggaagaaactactcaagttgtagaagcccctccccattttgaaccaaacctgtttggcgccaaggagaaaccaatctcaggtagcagccttgcagaaaggatggccccagggaatggcttatgtgccctccaaattgacacttctcgtgtcggttcttccgtgtcgatccggtctccggtcgtgattccaccgggcgcgcaaccttctcctaccactggcaaattgccatttcttatgcgtgctaatgctaatctagcaataccatcggtccataagaaggatgaagatctatcatcacgtgatggctgtacaatcttctttcagcccattttgaggcctaaaccaccaatttttccaaccacgaacaagacctcagtaggcgataatcggcaggatctaagccttcaatctagctcaactgcaaccaaggatgtcaccaggacaactagtgttaaacctaagaaacttgatttcatgtttgataatgatcaccccatccccatcccggacaaagaacaagaagagtgtgatgcagaccgagacgggaactattcgttagccccggtcattgctgctgaggatggatataactggaggaagtatggacagaagcaagtgaagaacagtgaccatccaagaagctactacaaatgcagccacccaaattgccctgtcaagaaaaaagtggagcgttgtcaggatggccatataacagagatagtctacaaaggttcccacaatcaccctttaccgcctcccagccaccacttccaagatgtgcatggtgaaattcttgggacaaaactaaagatggattctgtcacttcaaccactgccataggtaccatagacatagaggctatggcgtcgagagctgttcaggagcctcgtgtgattgtacagacaacaagtgatgtcgacatccttgacgatggttaccgttggcgcaagtacgggcagaaagttgtcaaaggcaatccaaatccaaggagctactacagatgcacacacccaggctgttcggtgcgcaagcacgtcgaaagagcgtcaaacgatccaaaatccgttatcacgacgtacgagggcaagcatgaccatgaagttccagctgccagaaacaccggaagcccaagttctggccctggtggcgcgccaccagctccaccgcaggctaatatccttcaccggagtccagaaccggcacaaggcagactgtcccagtctggtggtctcgctgcttatggctcaactggtcggtccggtgtggcagatgccttctcctctggaatgctgccacacggcatagcggttctggcaccgcctttggggacatttgcgccatcacagatatctggtcatccaccggcaatgcagggctatgcaaggcgcatgccgctaactggggaggagaaggtgaatccagcggcacagcatggcaagccagcaacaaataggacgacagcttaccagcagctgatgggcaggttgtctcaggatcctcagatg

SEQ ID NO: 1304 - protein, 565 aa, Brachypodium distachyon
  Bradi3g39340.1 polypeptide
MSGTGKRGALTEDWMLPTPSPRTLMLSLFNEDLSSGPCSDVFGDNKPQDGIDGAKPSLVVSSWEETTQVVEAPPHFEPNLFGAKEKPISGSSLAERMAPGNGLCALQIDTSRVGSSVSIRSPVVIPPGAQPSPTTGKLPFLMRANANLAIPSVHKKDEDLSSRDGCTIFFQPILRPKPPIFPTTNKTSVGDNRQDLSLQSSSTATKDVTRTTSVKPKKLDFMFDNDHPIPIPDKEQEECDADRDGNYSLAPVIAAEDGYNWRKYGQKQVKNSDHPRSYYKCSHPNCPVKKKVERCQDGHITEIVYKGSHNHPLPPPSHHFQDVHGEILGTKLKMDSVTSTTAIGTIDIEAMASRAVQEPRVIVQTTSDVDILDDGYRWRKYGQKVVKGNPNPRSYYRCTHPGCSVRKHVERASNDPKSVITTYEGKHDHEVPAARNTGSPSSGPGGAPPAPPQANILHRSPEPAQGRLSQSGGLAAYGSTGRSGVADAFSSGMLPHGIAVLAPPLGTFAPSQISGHPPAMQGYARRMPLTGEEKVNPAAQHGKPATNRTTAYQQLMGRLSQDPQM

SEQ ID NO: 1305 - DNA, 2022 bp, Oryza sativa
  LOC_Os08g38990.1
atggacgggaccaacaaccatggagcactgatggacgattggatgcttccctcacccagtccaagaacactcatgtcgagtttcttgaacgaagaattcagctccggtcccttttcagacattttctgtgataatggcagtaacaaacatcaggatggacttgggaagagcaaagctttcatcgattcaagccgggaagaaactgctcagctagcaaaaaagtttgaatcaaacctttttggtgccaaccagaaatcaagctcaaatggctgtctgtcagagaggatggctgcaaggacaggttttggtgtcctgaaaattgatacatctcgtgtcggttattctacaccgattcggtctccggtgacgatcccgcccggtgtgagtccaagggaacttcttgagtcgccggtttttcttccgaacgccattgcacaaccttctcctaccactggcaaactgccatttttgatgcatagtaatgttaaaccatcgatccctaaaaaaactgaagatgaaacacgccatgatcgtgtattcttctttcaacccattttgggatctaagccaccaacttgtccagttgcagagaagggtttcagtgttaatcatcaaaaccagccttcagtgacggataatcaccaggagctcagtcttcagtctagctcaactgcagccaaggatttcacttcagcaactattgttaaacctaagacatctgattccatgttagacaatgatgatcacccttcccctgcaaatgatcaagaagagaatgcaacaaacaaaaatgaagagtattcttcagacctgatcattacccctgctgaggatggatataactggaggaaatatggacagaagcaagttaagaacagtgagcatcccagaagctactacaaatgcactttcacgaattgcgctgtcaagaaggtggagcgttctcaagatggccaaataacagagatagtctacaaaggttctcacaatcaccctttgccgccttccaaccgccgaccaaatgttcctttctcacacttcaatgatctgagagatgatcactctgagaaatttggttccaagtctggtcaggccacagcaacttcatgggagaatgccgcaaatggacacctccaagatgtcggtagtgaagttctgacaaaactgtctgcttctcttacgacaacagaacatgctgaaaaatctgttatggacaaacaagaagctgtggatatctcatcgacgctctccaatgaagaggatgatagggtaacgcatcgtgccccgctttctctgggctttgatgcgaacgatgactatgttgaacacaagagaagaaagatggatgtttatgccgctactagcactagcaccaacgccatcgacataggagctgtggcgtcaagagctatccgggagcctcgcgttgttgttcagaccacaagtgaggttgacatccttgatgatggttaccgttggcgcaagtatgggcagaaagttgtcaaaggaaacccaaatccaaggagctactacaagtgcactcatccgggttgctcggtgcgcaagcatgtggagcgatcatcgcatgatctgaaatccgtcatcacgacgtatgaaggaaagcacaaccatgaagttccagctgccaggaacagtggccacccaagctcaggctcagccgctgcaccacaggctaccaatggtcttcttcaccggagacctgaaccggcacaaggtggtggtggtggtagccttgctcagtttggctatggctcagctggtcacagaccagcagagcagtttggtgcagcagcagctggtttctcctttggaatgctgcctcgtagcattgcaactccggcgccgtctccggcgatcgccgtgccggcgatgcaggggtacccagggcttgtgctgccgagaggtgagatgaaggtgaacttgctgccacagtctgggaatgctggtgcagcagctagccagcagctgatgggcaggttgccaaagcagcatcctcagatg

SEQ ID NO: 1306 - protein, 674 aa, Oryza sativa
  LOC_Os08g38990.1 polypeptide
MDGTNNHGALMDDWMLPSPSPRTLMSSFLNEEFSSGPFSDIFCDNGSNKHQDGLGKSKAFIDSSREETAQLAKKFESNLFGANQKSSSNGCLSERMAARTGFGVLKIDTSRVGYSTPIRSPVTIPPGVSPRELLESPVFLPNAIAQPSPTTGKLPFLMHSNVKPSIPKKTEDETRHDRVFFFQPILGSKPPTCPVAEKGFSVNHQNQPSVTDNHQELSLQSSSTAAKDFTSATIVKPKTSDSMLDNDDHPSPANDQEENATNKNEEYSSDLIITPAEDGYNWRKYGQKQVKNSEHPRSYYKCTFTNCAVKKVERSQDGQITEIVYKGSHNHPLPPSNRRPNVPFSHFNDLRDDHSEKFGSKSGQATATSWENAANGHLQDVGSEVLTKLSASLTTTEHAEKSVMDKQEAVDISSTLSNEEDDRVTHRAPLSLGFDANDDYVEHKRRKMDVYAATSTSTNAIDIGAVASRAIREPRVVVQTTSEVDILDDGYRWRKYGQKVVKGNPNPRSYYKCTHPGCSVRKHVERSSHDLKSVITTYEGKHNHEVPAARNSGHPSSGSAAAPQATNGLLHRRPEPAQGGGGGSLAQFGYGSAGHRPAEQFGAAAAGFSFGMLPRSIATPAPSPAIAVPAMQGYPGLVLPRGEMKVNLLPQSGNAGAAASQQLMGRLPKQHPQM

SEQ ID NO: 1307 - DNA, 2022 bp, Oryza sativa; identical to SEQ ID NO: 1305
  LOC_Os08g38990.2

SEQ ID NO: 1308 - protein, 674 aa, Oryza sativa; identical to SEQ ID NO: 1306
  LOC_Os08g38990.2 polypeptide

SEQ ID NO: 1309 - DNA, 2022 bp, Oryza sativa; identical to SEQ ID NO: 1305
  LOC_Os08g38990.4

SEQ ID NO: 1310 - protein, 674 aa, Oryza sativa; identical to SEQ ID NO: 1306
  LOC_Os08g38990.4 polypeptide

SEQ ID NO: 1311 - DNA, 2022 bp, Oryza sativa; identical to SEQ ID NO: 1305
  LOC_Os08g38990.3

SEQ ID NO: 1312 - protein, 674 aa, Oryza sativa; identical to SEQ ID NO: 1306
  LOC_Os08g38990.3 polypeptide

SEQ ID NO: 1313 - DNA, 2187 bp, Zea mays
  GRMZM2G027972_T01
atggatgattggatgcttccctcacccagcccaagaacactgatgccaagcttcttcagtgaagagttcatctccactccgttctccaacatcttcgctgacgatagaggcagcaaaccccaggatgaaaacgaggacagtaacacctgcattggttccggtgctcacgaaacctctcaagatgtgaaatgccatcgtccacagatcgaatcgaacatttttggcgtgaatcagaaaccgacctctcctggaggtcttgcggagaggatagctgcaagagccggttttggtgtcctgaaaattgacatatcccgtgtcggttcatctggtgcggcgattcggtctcccgtgacaattccatctggtgtgagcccaagggaacttcttgagtcgccggttttccttccaaatgccatttcgcaaccttctcctaccactggtaaattgccattcctgatgcctaataattttaaatcaacaatgctgtgtggccccgagaagtctgaagaccacttacacgaagattctgcgttttccttccagccctttttgaggtctaaaccaccaacattatggactgcaaagaaggggccaagtgttgttcacgaaaccgggtccttatcaaaggatagccaggaggagctaaaccttcatgctaacccagcagctgcgaccgagcatgaaaccgaggaaagtctagttattagacctaaggcatgtgattccatgttcgacaatggtcatccttcttcccctgacgaaggaccagaacagagcgaggaaaaccaaaaccgggaagattgttcagctccggtcactgcccccggcgaggatggatacaactggagaaaatatggacaaaagcaggtgaagaacagtgagcatccaaggagctactacaaatgcactcacccaagttgccctgtcaagaaaaaggtggagcgttctgtagaaggtcatgtaacggagatagtttacagaggttcgcatactcacccactgccgctgcccagccgccggtcgagcgtccctcccacgcagctcgagtgtggttcacaatctgatggtctggagaacttgagctccaagcctgggcctgcctatcactcagcagcttcacaatcacagggaattgctccagatggccagttccaagatgtgcatagggaagctcttgaaacaaaactgtctggctctcttactacaactgagattgctgacaggcccgttatggatgtctcatcaacactctcctccaatgagaatggtgatagggcagttcctccaaccaatggcaggaacgaagatgagaccgaatctaaaagaaggaaaatggaggcatctgccgctactaacactaccaccaacactggcattgacatggcggctatggcatccagggcttcccgtgagccccggattgtcgtgcaaacgacgagtgaggtcgacatccttgacgatggctaccgctggcgcaagtatggccagaaagttgtgaaaggcaacccgaacccaaggtcagtgccatttctgtatcaagaaaccaaccaagtggaatttccagttgctgaacgcacgcacgcacgcacccgcacccttcttctacctgcacgcaggagctactacaagtgcacctacgcgggctgctcggtgcgcaagcatgtcgagagggcctcgaacgatctcaagtccgtgatcacgacgtacgaggggaagcacaaccacgaggttccagctgccaggaacagcggcaacgggcatccgagctctggctccacaccagcaccaccacaggggagcggcggccttcaccggaggctggagccgccacaggtcagcatccctcggttgagcgctgctgctgccgccgccgccgccgccgctgcctacggctcgctctcgcttcgtttcccaccacagctcagcgcagctcccgggggtttctccttcggaatgctccgtcccactggcatggcaccgtctctgggcggcttcttgccagcgcagatgccaggccgtgggttgccgatgcagggctgcgcgggcctggtgctgccgagaggcgaggcgaaggtggtgagcccagagcagcagtccggattgccggtggcgaacgggaatgccgcggcaacctaccagcagcagcagcagcagctcatggccaggtgggctcagggtcatcagatg

SEQ ID NO: 1314 - protein, 729 aa, Zea mays
  GRMZM2G027972_T01 polypeptide
MDDWMLPSPSPRTLMPSFFSEEFISTPFSNIFADDRGSKPQDENEDSNTCIGSGAHETSQDVKCHRPQIESNIFGVNQKPTSPGGLAERIAARAGFGVLKIDISRVGSSGAAIRSPVTIPSGVSPRELLESPVFLPNAISQPSPTTGKLPFLMPNNFKSTMLCGPEKSEDHLHEDSAFSFQPFLRSKPPTLWTAKKGPSVVHETGSLSKDSQEELNLHANPAAATEHETEESLVIRPKACDSMFDNGHPSSPDEGPEQSEENQNREDCSAPVTAPGEDGYNWRKYGQKQVKNSEHPRSYYKCTHPSCPVKKKVERSVEGHVTEIVYRGSHTHPLPLPSRRSSVPPTQLECGSQSDGLENLSSKPGPAYHSAASQSQGIAPDGQFQDVHREALETKLSGSLTTTEIADRPVMDVSSTLSSNENGDRAVPPTNGRNEDETESKRRKMEASAATNTTTNTGIDMAAMASRASREPRIVVQTTSEVDILDDGYRWRKYGQKVVKGNPNPRSVPFLYQETNQVEFPVAERTHARTRTLLLPARRSYYKCTYAGCSVRKHVERASNDLKSVITTYEGKHNHEVPAARNSGNGHPSSGSTPAPPQGSGGLHRRLEPPQVSIPRLSAAAAAAAAAAAYGSLSLRFPPQLSAAPGGFSFGMLRPTGMAPSLGGFLPAQMPGRGLPMQGCAGLVLPRGEAKVVSPEQQSGLPVANGNAAATYQQQQQQLMARWAQGHQM

SEQ ID NO: 1315 - DNA, 2007 bp, Setaria italica
  Si013374m
atggccggaactgacaaccgcagagcattgatggaggattggatgcttccttcacccagcccaagaacagtgatgtcaagcttcttgaacgaagaattcagctcttgtccattctccagcatcttcagtgacaatggcagcagcaaaccactggatgcaattgagaagagcaaaactttagttgattcgagcgttgaagaaactgttcaaaatacaaaagcccctctgcagcttgaatcaaacctttttagggcaaatcaggaatcaacctcacatggaggtcttgcggagaggatggctgcaagggccggttttggtgtcctgaaaattgacacatctcgtgtcagttcttctgcgccaatccggtcgcctgtgacaataccacctggtgtgagtccaagggagcttctcgagtcaccagtttttctacccaatgccattgcgcaaccttctcctacaactggcaagttgccatttctaatgcctaataacttcaagtcaatgatatcctcggtccccaagaaggctgaagattacttccacgatgattgtgcattttccttccagcccattttgatgtctaagcccccaagtttttcaactgtggacaagggtttgagtgctgttcaccaaaatcagtccttagcaaattatagtcaggagttaagtcttcaggctaacacaactgcaaccaaggatgaaactgaggaaaatcttgttaaacctagcacatgtgattccatgttagataatgaccatccttcccctgctgatgaacaagaagagagtgaggaaaaccaaaatgaagaagattcctcagttccagttatcgcacctgctgaggatggatataactggagaaaatatggacaaaagcaagtgaagaacagtgagcacccaaggagctactacaaatgcactcacccaaattgccctgtcaagaaaaaggtggagcgttctcaaaagggtcatataacggagatagtctacaaaggttctcacagtcaccctttgccgcctcccaaccgccggccaagtgtcccgtcgtcacatgtcaatgatttgcaagctgatggctctgagaacttttgttcaaagcctgtgaagttcttgaaaagaaatctgtctggttctcttaccacaacagagattgctgatacatgtgttatggagtcccaagaagctgtagatgtctcgtctacactctcctccaacgaaaaagatgagagggcaacacaatgtaccattccctcgacctatcgcggggatgacgatgagactgaatctaaaagaaggaagatggaggtttctgctgctgctaacactaccaccaatgccattgacatggcagctatggcatcaagagctgtacgggagcctaggattgttgtgcagaccacaagtgaggttgacatccttgatgatggctaccgctggcgcaagtacgggcagaaagttgtcaaaggaaatccaaacccaaggagctactacaaatgcacttatgcaggctgcacagtgcgcaagcatgtggagagagcctcaaatgatctcaagtccgtgatcacgacgtatgagggcaagcacaaccatgaagttccagctgccagaaacagtagtgggcatccgaactctggttccaatgctgcgccacagggtagcaaccttcaccggaggccagaaccggcacaacccagcatcccgcagctgaacgctgctgctgcttatggctcacttggtctcccaccacaactcagcgcagcttcaggtggtttctccttcggattgctcccacctggcatggcggtaccagtaccatctctggggaccttcatgccagcacctatacctggtcatccgccaacaatgcagggctgcacagggcttgtggtgccaagaggtgaggtgaaggtgaacttagaggagcagtccagattgcaggtggcaaacgggaatgccatggcagcttaccagcagttcatgggcaggttgcctcagggtcctcagatg

SEQ ID NO: 1316 - protein, 669 aa, Setaria italica
  Si013374m polypeptide
MAGTDNRRALMEDWMLPSPSPRTVMSSFLNEEFSSCPFSSIFSDNGSSKPLDAIEKSKTLVDSSVEETVQNTKAPLQLESNLFRANQESTSHGGLAERMAARAGFGVLKIDTSRVSSSAPIRSPVTIPPGVSPRELLESPVFLPNAIAQPSPTTGKLPFLMPNNFKSMISSVPKKAEDYFHDDCAFSFQPILMSKPPSFSTVDKGLSAVHQNQSLANYSQELSLQANTTATKDETEENLVKPSTCDSMLDNDHPSPADEQEESEENQNEEDSSVPVIAPAEDGYNWRKYGQKQVKNSEHPRSYYKCTHPNCPVKKKVERSQKGHITEIVYKGSHSHPLPPPNRRPSVPSSHVNDLQADGSENFCSKPVKFLKRNLSGSLTTTEIADTCVMESQEAVDVSSTLSSNEKDERATQCTIPSTYRGDDDETESKRRKMEVSAAANTTTNAIDMAAMASRAVREPRIVVQTTSEVDILDDGYRWRKYGQKVVKGNPNPRSYYKCTYAGCTVRKHVERASNDLKSVITTYEGKHNHEVPAARNSSGHPNSGSNAAPQGSNLHRRPEPAQPSIPQLNAAAAYGSLGLPPQLSAASGGFSFGLLPPGMAVPVPSLGTFMPAPIPGHPPTMQGCTGLVVPRGEVKVNLEEQSRLQVANGNAMAAYQQFMGRLPQGPQM

SEQ ID NO: 1317 - DNA, 2184 bp, Brachypodium distachyon
  Bradi5g13090.1
atggccatggagcagtggaagcagcaccctaacccaggcccagaatgcctgatgccgagcttcctgaccgaccagttccccccggatcccttggcggaggacggcagcggcaacgaggccgggttcgagaagcacggcctgtctgtggccgtgggttcgcctcaggacgaagggaagccggcgcaattgacgccgcacttcggcggccggatgtccggttccagcagcagcctctccgagaggatgcaggcgagaaacgggttcagcgtccccaagctcagcatgccgttcgccactccggccggagatgacagtgagcagtcgggggttcagccgcctatctttaccgtcccgccgggcctcagccccgcgtcgctgttggaatcgccggtcttcctctccaatgcaatgggccaagcctcgccaaccacagggaagttgttcatgcttggtgatgccgatgacaataatccgactagaattgaagctccctcgattgaagatggccctgctgcattttctttcaagtctttggacctgaaatcctcacgttatattgctgaagaaatgaaggaaactttacccagcaaccagcatccgtcattaccaagcagagatgttcctgtcaagactgaaaccaacattcaggcgacacaaggcgccaacccgctgggcaacaaagtctatttcaacgggcaagagctaatgaagagcagctaccatgactccaacaagcgcaaccgtctcgcacctgacaccattgtgggcagagacagcggatcgcctcccgatcacagccaaccggcggcggacagcgaagcgaaccctgcgacgatggcgaccgccgccacggccacgccggcggaggacgggtacagctggaggaagtacgggcagaagcaggtgaagcacagcgagtacccgcggagctactacaagtgcacgcaccagagctgccaggtgaagaagaaggtggagcggtcgcacgagggccacgtcacggagatcatctacaagggcacccacaaccaccccaagcctgccgctcagggccgccgcctgccgggcgtcccgcaggtccacccgttcggtgacatggacatcgccgccgacaacaacaacaacaacgacaataacggtaatgctggtggtgccacgcagcagccgaacgcggaagcgaggccgttgtggcacggtggcggcggcatgggtgtccaggactggcgcggcggcgatgggctggaggcgacgtcgtccccaggcgagctctgcgactcgtcggcttcgatgcaggtccatgacggcaccgccacccggttcgggtcccctgagggcgtggatgtcacgtcggcggtgtctgacgaggtggacggggatgacagggtgcgcgcgcatggcagcatgtcccagggccacaaccagggcgctgccgacgccggcgagggagatgaactggagtccaagagaaggaagctggagtcgtgcgccattgaaatgagcaccgcgtccagagctgtccgcgagccacgggtcgtgatccagacgacgagcgaggtggacatcctggacgacggctaccgctggcgcaagtacgggcagaaggtggtcaaaggcaacccaaacccaaggagctactacaagtgcacgcacccggggtgctcggtgcggaagcacgtggagcgtgcgtcgcacgacctcaagtccgtgatcacaacgtacgaggggaagcacaaccacgaggtcccggccgccaggaacggtggcggccacgcgacctcgggctccgcggcggcccagctggcccacgcgcgcaggccggagccgccgtcgatggcgcaggacgggctgatgatgggccggctgggcgcgcccttcggcctgccgccgagggacccgctggggcccatgagcaacttcccgtactcgctcggcgtcggcggctacgcgtcgtcgggatcgctgccaagcctgccgatgccggcggccgtggaagggctgaagctgccgatgctgtccccgtgctcgctgcacccgctcttcaggcaccggcaggccatggatcagacggcggccgggtccgggttcagggtgcccaagggcgaggtgaaggacgagtccaacaacaactccagcgcctcggcgtatcagcagatgatgaacaggctgcccctggggcaccggatg

SEQ ID NO: 1318 - protein, 728 aa, Brachypodium distachyon
  Bradi5g13090.1 polypeptide
MAMEQWKQHPNPGPECLMPSFLTDQFPPDPLAEDGSGNEAGFEKHGLSVAVGSPQDEGKPAQLTPHFGGRMSGSSSSLSERMQARNGFSVPKLSMPFATPAGDDSEQSGVQPPIFTVPPGLSPASLLESPVFLSNAMGQASPTTGKLFMLGDADDNNPTRIEAPSIEDGPAAFSFKSLDLKSSRYIAEEMKETLPSNQHPSLPSRDVPVKTETNIQATQGANPLGNKVYFNGQELMKSSYHDSNKRNRLAPDTIVGRDSGSPPDHSQPAADSEANPATMATAATATPAEDGYSWRKYGQKQVKHSEYPRSYYKCTHQSCQVKKKVERSHEGHVTEIIYKGTHNHPKPAAQGRRLPGVPQVHPFGDMDIAADNNNNNDNNGNAGGATQQPNAEARPLWHGGGGMGVQDWRGGDGLEATSSPGELCDSSASMQVHDGTATRFGSPEGVDVTSAVSDEVDGDDRVRAHGSMSQGHNQGAADAGEGDELESKRRKLESCAIEMSTASRAVREPRVVIQTTSEVDILDDGYRWRKYGQKVVKGNPNPRSYYKCTHPGCSVRKHVERASHDLKSVITTYEGKHNHEVPAARNGGGHATSGSAAAQLAHARRPEPPSMAQDGLMMGRLGAPFGLPPRDPLGPMSNFPYSLGVGGYASSGSLPSLPMPAAVEGLKLPMLSPCSLHPLFRHRQAMDQTAAGSGFRVPKGEVKDESNNNSSASAYQQMMNRLPLGHRM

SEQ ID NO: 1319 - DNA, 2994 bp, Oryza sativa
  LOC_Os04g39570.1
atgacgatgacgaccgcgacgctggatccgccgccgcctcccctcctcatcgccggctccctcctcgacgacgatcgcgacgctggatctgccgcctcctcctctcctcgctggctcccccgggcgcgcggatccaccgtcggctcccctcctcgccggggaggggaggagaggggaggggaggcggcgacgaggaggaaaggcaacagctcctgtcctgacgacgacgatgactgccgcaacgacgaggacgactgccgcaacgacgacgactaccgcgacgatgatgtgggggcgacgacggatggaggaggagacgcggcggctcttctcccgatggcgatgatgactgccacgacgatggcgccgatgcctgtcgaggcagcggtggacggaggaggagagctgtcatcggccggagagggtggccagcggcgggtgaatctactgcctacgaagatattgtccgcctacgaaaatcatctattttcgcaggcccttgcttgcagggaagatgaatggatcatcgagaagcttgcggtcatcgctgctagacgctcatcatttgtctctgaagaatccttgtgctctgttccggctgcggctttggtctctttggccattgcccatttggctttctcccccatgttggtctatggcgttcttgatcgtttatgttccgtttgccatctgggtgagatggagggagacatagcgatggaggagtggaaggattccaaccatcgaggcgcggattacctgatgacgatgccgatgcagaacttcctcgccgacgcgttcccgccaccggagctcttggagggagaaggcgggttcgagaagcacggcctgtcggtggccgttggctcgccgccgccgacgccgccgcctccggaggacgggtgctcgccgctgccactgacgccgcagttcggccagaagttcggctccggcggcggcggcggcggcagcctcgccgacaggagggcgagaggcgggttcagcaacgtcgccaggatcagcgtgccgtacaaccagccggcggcggacgtgtcgtcggcgggggcgccgtcgccgtacgtgacgatcccgcccggcctgagcccgacgactctgctggaatcgccggtcttctccaatgccatgggccaggcctcgccgaccactgggaagctgcacatgcttggtggtgccaacgacagcaatccaatcagatttgaatcccctcggatcgaagaaggatctggtgcattttctttcaagcctctgaatctcgcatcctcacactacgcagctgaagaaaagacgaaatctctacccaacaaccagcatcagtcgctaccgatttctgtcaagactgaagctactagcattcaaaccgcacaagatgaagcagcagccaaccaactgatgcagccgcagttcaacggcggcaagcggagccgcgctgcacctgacaacggcggcgacggcgagggccagccggcggagggcgacgcgaaggctgactcctcctccggcgcggccgcggtcgccgtcgtcgccgccgccgcggcggcggtggcggaggacgggtacagctggaggaagtacgggcagaagcaggtgaagcacagcgagtacccgaggagctactacaagtgcacgcacgccagctgcgcggtgaagaagaaggtggagcgctcgcacgagggccacgtcacggagatcatctacaagggcacccacaaccaccccaagccggcggcgagccgccgcccccccgtccatcctccgccgccgtcgccggcgacgacgacgacgacgccgctgccgccaggcgacgcgcaggccgaccacgcgcccgacggcggcggcggcagtaccccagttggcgccggacaggcgggcgcggagtggcacaacggcggcgtggttggcggcgaggggctggtggacgcgacgtcgtctccctccgtccccggcgagctctgcgagtcgacggcgtcgatgcaggtccatgaaggcgcggcggcggcgcagctgggggaatcccccgagggcgtcgacgtcacgtctgcggtgtccgacgaggtggacagggatgacaaggcgacgcacgtgttgcccctggccgccgccgccgccgacggcgagagcgacgagctggagcgaaagagaaggaagctggactcctgcgccaccatggacatgagcacggcgtcgagggcggtgcgcgagccgcgggtggtgatccagacgacgagcgaggtggacatcctcgacgacggctaccgctggcgcaagtacgggcagaaggtcgtcaaggggaaccccaacccaaggagctactacaagtgcacgcacccggggtgcctggtgcggaagcacgtggagcgcgcgtcgcacgacctcaagtcggtgatcaccacgtacgaggggaagcacaaccacgaggtccccgcggcgaggaacagcggccacccggcgggctcggcttcgcccggcggcggcgcggggtcgtcgtcgcagccccacggcgtcggcgtcggcgggcgcaggccggaggtgccgtcggtgcaggagagcctgatgaggctcggcggcggctgcggcgcggcgccgttcccgccccacttcggcctgcacctgccgccgccgccgccgagggacccgctcgcgccgatgagcaacttcccctactcgctcggccacgcgccgtcgccggcgctgcggggcctgccgccgcccccgcccccgccgccgtcggcgtcggcgctggcggtggcggggctcggcggcgtggtggaggggctcaagtacccgatgctggcgccgccgtcggtgcactcgctgctgaggcaccgccagggcggcggcatggaggcggtggtggtccccaaggcggaggtgaagcaggaggcgatgcggcccgccgccgccgtcgccggcgcggggcgcggcgcggcggtgtatcagcaggcgatgagcagggtgtcgctggggaatcaactg

SEQ ID NO: 1320 - protein, 998 aa, Oryza sativa
  LOC_Os04g39570.1 polypeptide
MTMTTATLDPPPPPLLIAGSLLDDDRDAGSAASSSPRWLPRARGSTVGSPPRRGGEERGGEAATRRKGNSSCPDDDDDCRNDEDDCRNDDDYRDDDVGATTDGGGDAAALLPMAMMTATTMAPMPVEAAVDGGGELSSAGEGGQRRVNLLPTKILSAYENHLFSQALACREDEWIIEKLAVIAARRSSFVSEESLCSVPAAALVSLAIAHLAFSPMLVYGVLDRLCSVCHLGEMEGDIAMEEWKDSNHRGADYLMTMPMQNFLADAFPPPELLEGEGGFEKHGLSVAVGSPPPTPPPPEDGCSPLPLTPQFGQKFGSGGGGGGSLADRRARGGFSNVARISVPYNQPAADVSSAGAPSPYVTIPPGLSPTTLLESPVFSNAMGQASPTTGKLHMLGGANDSNPIRFESPRIEEGSGAFSFKPLNLASSHYAAEEKTKSLPNNQHQSLPISVKTEATSIQTAQDEAAANQLMQPQFNGGKRSRAAPDNGGDGEGQPAEGDAKADSSSGAAAVAVVAAAAAAVAEDGYSWRKYGQKQVKHSEYPRSYYKCTHASCAVKKKVERSHEGHVTEIIYKGTHNHPKPAASRRPPVHPPPPSPATTTTTPLPPGDAQADHAPDGGGGSTPVGAGQAGAEWHNGGVVGGEGLVDATSSPSVPGELCESTASMQVHEGAAAAQLGESPEGVDVTSAVSDEVDRDDKATHVLPLAAAAADGESDELERKRRKLDSCATMDMSTASRAVREPRVVIQTTSEVDILDDGYRWRKYGQKVVKGNPNPRSYYKCTHPGCLVRKHVERASHDLKSVITTYEGKHNHEVPAARNSGHPAGSASPGGGAGSSSQPHGVGVGGRRPEVPSVQESLMRLGGGCGAAPFPPHFGLHLPPPPPRDPLAPMSNFPYSLGHAPSPALRGLPPPPPPPPSASALAVAGLGGVVEGLKYPMLAPPSVHSLLRHRQGGGMEAVVVPKAEVKQEAMRPAAAVAGAGRGAAVYQQAMSRVSLGNQL

SEQ ID NO: 1321 - DNA, 2349 bp, Oryza sativa
  LOC_Os04g39570.2
atggagggagacatagcgatggaggagtggaaggattccaaccatcgaggcgcggattacctgatgacgatgccgatgcagaacttcctcgccgacgcgttcccgccaccggagctcttggagggagaaggcgggttcgagaagcacggcctgtcggtggccgttggctcgccgccgccgacgccgccgcctccggaggacgggtgctcgccgctgccactgacgccgcagttcggccagaagttcggctccggcggcggcggcggcggcagcctcgccgacaggagggcgagaggcgggttcagcaacgtcgccaggatcagcgtgccgtacaaccagccggcggcggacgtgtcgtcggcgggggcgccgtcgccgtacgtgacgatcccgcccggcctgagcccgacgactctgctggaatcgccggtcttctccaatgccatgggccaggcctcgccgaccactgggaagctgcacatgcttggtggtgccaacgacagcaatccaatcagatttgaatcccctcggatcgaagaaggatctggtgcattttctttcaagcctctgaatctcgcatcctcacactacgcagctgaagaaaagacgaaatctctacccaacaaccagcatcagtcgctaccgatttctgtcaagactgaagctactagcattcaaaccgcacaagatgaagcagcagccaaccaactgatgcagccgcagttcaacggcggcaagcggagccgcgctgcacctgacaacggcggcgacggcgagggccagccggcggagggcgacgcgaaggctgactcctcctccggcgcggccgcggtcgccgtcgtcgccgccgccgcggcggcggtggcggaggacgggtacagctggaggaagtacgggcagaagcaggtgaagcacagcgagtacccgaggagctactacaagtgcacgcacgccagctgcgcggtgaagaagaaggtggagcgctcgcacgagggccacgtcacggagatcatctacaagggcacccacaaccaccccaagccggcggcgagccgccgcccccccgtccatcctccgccgccgtcgccggcgacgacgacgacgacgccgctgccgccaggcgacgcgcaggccgaccacgcgcccgacggcggcggcggcagtaccccagttggcgccggacaggcgggcgcggagtggcacaacggcggcgtggttggcggcgaggggctggtggacgcgacgtcgtctccctccgtccccggcgagctctgcgagtcgacggcgtcgatgcaggtccatgaaggcgcggcggcggcgcagctgggggaatcccccgagggcgtcgacgtcacgtctgcggtgtccgacgaggtggacagggatgacaaggcgacgcacgtgttgcccctggccgccgccgccgccgacggcgagagcgacgagctggagcgaaagagaaggaagctggactcctgcgccaccatggacatgagcacggcgtcgagggcggtgcgcgagccgcgggtggtgatccagacgacgagcgaggtggacatcctcgacgacggctaccgctggcgcaagtacgggcagaaggtcgtcaaggggaaccccaacccaagctcctcctcctccatggatgctgatcgatctctcgtcgtcgtcgtcgtgatcaggagctactacaagtgcacgcacccggggtgcctggtgcggaagcacgtggagcgcgcgtcgcacgacctcaagtcggtgatcaccacgtacgaggggaagcacaaccacgaggtccccgcggcgaggaacagcggccacccggcgggctcggcttcgcccggcggcggcgcggggtcgtcgtcgcagccccacggcgtcggcgtcggcgggcgcaggccggaggtgccgtcggtgcaggagagcctgatgaggctcggcggcggctgcggcgcggcgccgttcccgccccacttcggcctgcacctgccgccgccgccgccgagggacccgctcgcgccgatgagcaacttcccctactcgctcggccacgcgccgtcgccggcgctgcggggcctgccgccgcccccgcccccgccgccgtcggcgtcggcgctggcggtggcggggctcggcggcgtggtggaggggctcaagtacccgatgctggcgccgccgtcggtgcactcgctgctgaggcaccgccagggcggcggcatggaggcggtggtggtccccaaggcggaggtgaagcaggaggcgatgcggcccgccgccgccgtcgccggcgcggggcgcggcgcggcggtgtatcagcaggcgatgagcagggtgtcgctggggaatcaactg

SEQ ID NO: 1322 - protein, 783 aa, Oryza sativa
  LOC_Os04g39570.2 polypeptide
MEGDIAMEEWKDSNHRGADYLMTMPMQNFLADAFPPPELLEGEGGFEKHGLSVAVGSPPPTPPPPEDGCSPLPLTPQFGQKFGSGGGGGGSLADRRARGGFSNVARISVPYNQPAADVSSAGAPSPYVTIPPGLSPTTLLESPVFSNAMGQASPTTGKLHMLGGANDSNPIRFESPRIEEGSGAFSFKPLNLASSHYAAEEKTKSLPNNQHQSLPISVKTEATSIQTAQDEAAANQLMQPQFNGGKRSRAAPDNGGDGEGQPAEGDAKADSSSGAAAVAVVAAAAAAVAEDGYSWRKYGQKQVKHSEYPRSYYKCTHASCAVKKKVERSHEGHVTEIIYKGTHNHPKPAASRRPPVHPPPPSPATTTTTPLPPGDAQADHAPDGGGGSTPVGAGQAGAEWHNGGVVGGEGLVDATSSPSVPGELCESTASMQVHEGAAAAQLGESPEGVDVTSAVSDEVDRDDKATHVLPLAAAAADGESDELERKRRKLDSCATMDMSTASRAVREPRVVIQTTSEVDILDDGYRWRKYGQKVVKGNPNPSSSSSMDADRSLVVVVVIRSYYKCTHPGCLVRKHVERASHDLKSVITTYEGKHNHEVPAARNSGHPAGSASPGGGAGSSSQPHGVGVGGRRPEVPSVQESLMRLGGGCGAAPFPPHFGLHLPPPPPRDPLAPMSNFPYSLGHAPSPALRGLPPPPPPPPSASALAVAGLGGVVEGLKYPMLAPPSVHSLLRHRQGGGMEAVVVPKAEVKQEAMRPAAAVAGAGRGAAVYQQAMSRVSLGNQL

SEQ ID NO: 1323 - DNA, 2016 bp, Zea mays
  GRMZM2G031963_T01
atggaaggccatgtagcaatggggtggaaggatcctaatccaggccaagaatcttccatggtcttccaatccagagctgttcggccagacaccgtagaggggcacagcaacgaggacgttgaagccggatttgagaagcatggcttgtcagccgccttaaactcgcctcagcacgaaggccgatcactgccactgaccccacagtttggccagaactccagtcctggaagcagcctcgccgagaggatgcaggcaagagccggattcaaggtgccgaagctgaacatgcctttcagcacggtagctggagatgatagttcagtgccaggagctccatcgccctacctcacgatcccgcctggcttgagcccagcaacgctgctggagtcacctgtcttcatttcgaatgccctgggacaagcctcaccaaccacggggaagctattcttgtttggtagcacaaatgacaacgatcctattcgacctggaggccctccagttggagatggcactgatgctttttctttcaagcccttagatctgaaatcctcacactacactgctgaagtaatgaaggaacaaaatacgcagtcttctgtgaagactgaagctaagactcaggcagtccaagaggctaatttgctgggccaactgaaccagcagaatcacgatgggcagacaaacatgaatagtgacggtgctcgtgactccaagctcagccgtcttgcgtctggcaccggtgcaggcaatgaacacgcatcacccccggattacggccagagagccgaggaagctgatgcgagggaagactacccggcggcaatggccgttacagcgccagcggaggacgggtacagctggaggaagtacgggcagaagcaggtgaagcacagcgagtacccgcgcagctacttcaagtgcacgcatcccaactgcctggtgaagaagaaggttgagcgctcgcacgaggggcacgtcacggagatcatctacaagggaacgcacaaccacccgaagcccacgcagagccgccggccaggcgcaggcgcgcacccgttgggcggcggtgcgcaggcggacgcagccgacaacctgcaggggtcacaggcaaacgcggcggaagccaaccaggcgtggcgtgcgggtgtccaggatggcgtggacgcgacgtcgcccccgtcggttcccggtgagctctgtgactcggcggcgtcgatgcaggtcgactgcgcggcccggtttgggtcccccgagggcgcggacgtgacgtctgccgtgtctgacgaggtggacggggacgacagggtgactctgactcatggcggtgccaacgcggcggagggcgacgaactggaatctaaacgaagagctgaccgtctgtctggttatttcaggaagctggagtcatacgccattgacatgagcactgcgtcgagagctgttcgcgagcctcgagtggtgatccaaacgacgagcgaggtggacatcctcgatgacggctaccgctggcgcaagtacgggcagaaggtcgtcaagggcaacccgaatccaaggagctactacaagtgcacgcaaccgggctgcacggtgcggaagcacgtggagcgcgcgtcgcacgacctcaaggccgtgatcaccacgtacgagggcaagcacaaccacgaggttcccgccgcgaggaacagcggccacccgagcgccgcggcggcgccaggcgcgggtggcccgcgcaggcaggagcacccgtccgtgcacgacggcctgatgagacagcacctgggcggctgcggcgtgccgttcggcctgccgccgccgccgccgccgccaagggacccgctggcgccgatgcgcaactacccgacgtacggcttcactgcccttggcgccggctccacgtcactgccgagcctgccgatgctcccggtgttggcgccgtcctccctgcaccagcacccgctgctgaggcaccggcaggcggtgcaggctgccggtctcgcgtggcgcccaaggccgacg

SEQ ID NO: 1324 - protein, 672 aa, Zea mays
  GRMZM2G031963_T01 polypeptide
MEGHVAMGWKDPNPGQESSMVFQSRAVRPDTVEGHSNEDVEAGFEKHGLSAALNSPQHEGRSLPLTPQFGQNSSPGSSLAERMQARAGFKVPKLNMPFSTVAGDDSSVPGAPSPYLTIPPGLSPATLLESPVFISNALGQASPTTGKLFLFGSTNDNDPIRPGGPPVGDGTDAFSFKPLDLKSSHYTAEVMKEQNTQSSVKTEAKTQAVQEANLLGQLNQQNHDGQTNMNSDGARDSKLSRLASGTGAGNEHASPPDYGQRAEEADAREDYPAAMAVTAPAEDGYSWRKYGQKQVKHSEYPRSYFKCTHPNCLVKKKVERSHEGHVTEIIYKGTHNHPKPTQSRRPGAGAHPLGGGAQADAADNLQGSQANAAEANQAWRAGVQDGVDATSPPSVPGELCDSAASMQVDCAARFGSPEGADVTSAVSDEVDGDDRVTLTHGGANAAEGDELESKRRADRLSGYFRKLESYAIDMSTASRAVREPRVVIQTTSEVDILDDGYRWRKYGQKVVKGNPNPRSYYKCTQPGCTVRKHVERASHDLKAVITTYEGKHNHEVPAARNSGHPSAAAAPGAGGPRRQEHPSVHDGLMRQHLGGCGVPFGLPPPPPPPRDPLAPMRNYPTYGFTALGAGSTSLPSLPMLPVLAPSSLHQHPLLRHRQAVQAAGLAWRPRPT

SEQ ID NO: 1325 - DNA, 2109 bp, Zea mays
  GRMZM5G816457_T01
atggaaggtcatgtagcaatggagtggaatgatcctaatccaggcccagaatccttgacgagcttccaaaccgaagctgttcgaccagacaccgcagggggccacagcaacgacgacgttgaagctggatttgagaagcatggcttggcagtcaccgtaaggccgcctgaggaggaagctcggtcagtgccactaaccccacagcttggccagaagtccagtcctggcagcagcctcgcggagaggatgcaggcaagagctggattcatggtgtcgaagctcaacatgcccttcagcacagcagctggagctgacaattcagtacccgaagttccatcgccctacctcacgattccgcctggcctgagcccagcaacgctgctggagtcaccagtcttcgtttctaattccatgggccaggcctcgccaaccacggggacgctattcatgtttggtagcacaaatgacaatgatcctattagatttggaggtggtcctccttcagttggagatggccctaatgcttttcctttcaagcccttagatctgaaatcctcacactacactgctgaagcaatgaaggaacaaaatacgaagtcttctgtcaagactgaaaccaagattctgacagtacaagaggctagtttgctcagccaactgaaccagctgaatcacaattcgcagaccattattaatagtggcggtcctcatgaccccaagctcagccgtcctgcatctggcgccggtgcaggcaatgaacacatatcacccccggatcacggacagacagctgaggaaagtgatgcgagggaagactacccggcaatggctactaccacgccagcagaggacgggtacagctggaggaagtacgggcagaagcaggtgaagcacagcgagtacccgcgtagctacttcaagtgcacgcatcccaactgcctggtgaagaagaaggtcgagcgctcgcacgaggggcacatcacggagatcatctacaagggcgcgcataaccacccgaagcccacgcagagccgccgtccaggcgtccagcccgtgcacccgtttggcgacagtgcgcaggcggacgcagccgacaacctggggtcacaggcaaacgcactggacgccaaccagccgaggcgtgcgggtgttcaggatggcatggacgcgacgtcgtcgccctcagttcccattgagcgctgtgactcgccggcctcgatgcaggtcgactcggcaactcggtttgggtcccccgagggcgcggatgtgacgtctgtgtccgacgaggtgggcggggacgacagggtgactcgtggcagtatgtctcagggcggtgccgacgcggagggtgacgagctggaatgtaaacgaaggaagctggagtcgtacgccatcgatatgagcaccgcgtcgagagctgttcgcgagcctcgcgtggtgatccagacgacgagcgaggtggacatcctagatgacggctaccgctggcgcaagtacgggcagaaggtcgtcaagggcaacccgaatccaaggagctactacaagtgcacgtacccgggctgcgtggtgcggaagcacgtggagcgcgcgtcgcacgacctcaagtccgtgatcaccacgtacgagggcaggcacaaccacgaggtccccgccgccaggaatagcggccacccgggcaccgcggcggcgacaggcgcgggtggcccgcgcaggctggagcacccgtcgctgcgcgacggcctgatggggcacttgggcggctgcggcgtgccgttcggcctgccgccgcctagggatccgctggcgccgatgggcaattacccgacgtatgcctcctccattccccttggcggcgccggccccacgtcactgccgagcctgccggtgccggcggggaccctcagcgccgtcgatgggctgaagctcccgatgctggcgccgtcgtccctgcagcagcacccgctgctgaggcaccggcaggcgatgcaggccgctggcctcgtggcgcccaaggacgacgtgaaggtcgagggcaacgttgccggcggcgctgccccgtcggtgtaccagcagatgatgtgcagcgggctgcggttgcgccagcagatg

SEQ ID NO: 1326 - protein, 703 aa, Zea mays
  GRMZM5G816457_T01 polypeptide
MEGHVAMEWNDPNPGPESLTSFQTEAVRPDTAGGHSNDDVEAGFEKHGLAVTVRPPEEEARSVPLTPQLGQKSSPGSSLAERMQARAGFMVSKLNMPFSTAAGADNSVPEVPSPYLTIPPGLSPATLLESPVFVSNSMGQASPTTGTLFMFGSTNDNDPIRFGGGPPSVGDGPNAFPFKPLDLKSSHYTAEAMKEQNTKSSVKTETKILTVQEASLLSQLNQLNHNSQTIINSGGPHDPKLSRPASGAGAGNEHISPPDHGQTAEESDAREDYPAMATTTPAEDGYSWRKYGQKQVKHSEYPRSYFKCTHPNCLVKKKVERSHEGHITEIIYKGAHNHPKPTQSRRPGVQPVHPFGDSAQADAADNLGSQANALDANQPRRAGVQDGMDATSSPSVPIERCDSPASMQVDSATRFGSPEGADVTSVSDEVGGDDRVTRGSMSQGGADAEGDELECKRRKLESYAIDMSTASRAVREPRVVIQTTSEVDILDDGYRWRKYGQKVVKGNPNPRSYYKCTYPGCVVRKHVERASHDLKSVITTYEGRHNHEVPAARNSGHPGTAAATGAGGPRRLEHPSLRDGLMGHLGGCGVPFGLPPPRDPLAPMGNYPTYASSIPLGGAGPTSLPSLPVPAGTLSAVDGLKLPMLAPSSLQQHPLLRHRQAMQAAGLVAPKDDVKVEGNVAGGAAPSVYQQMMCSGLRLRQQM

SEQ ID NO: 1327 - DNA, 2109 bp, Zea mays; identical to SEQ ID NO: 1325
  GRMZM5G816457_T02

SEQ ID NO: 1328 - protein, 703 aa, Zea mays; identical to SEQ ID NO: 1326
  GRMZM5G816457_T02 polypeptide

SEQ ID NO: 1329 - DNA, 2034 bp, Setaria italica
  Si012785m
atggaggagtggaaggatcctaatccaccagaatccttgatgcggggcttccagaccggaacatttccaccagacgcagaggttgccaaggccggatttgagaaggaaggccggtcgctgccaatgaccccgcagtttggccagaagtccagtccgggcagcagcctcgccgagagaatgcaggcaagagctggattcagggtgccaaagctcagcatgccgttcagcactgcagttggagctgataattcagtgccaggagctccatcgccctacctcacgatccctcctggtttgagcccggcaacactgctggactcaccagtcttcatttccaatggcatgggccaaacctcgccaaccacagggaaattattcaggcttggtggaacaaatgacaatgatcctattagatttggaggctctccacttggagctggccctgactcattttctttcaagcctttagatctgaaatcctcactctacactgctgaaggaaagaagcctccactaccaagcactcatgtttctgtcaagactgaaactaagattcagcctgtacaagaggccaatttgctgggcaaactgaatcagcagaatcaaagcgggcagaccaatttgaagagtggttctcatgactccaagctcagccgtcttgcacctgtcactggtgcaggcaatgaacacgtatcatccccgcacggccagcccatggaggaaggcgacgctaggggaggagactacacagcaattgccacatctacaccggcagaggatggatacagctggaggaagtacgggcagaagcaggtgaagcacagcgagtacccgcggagctacttcaagtgcacgcacctgaactgccaggtcaagaagaaggtggagcgatcgcacgaggggcatatcacagagatcatctacaagggcacgcacaaccacccgaagcccactcagagtcgccgcccaggagtcccacccttgcacccgtttggcgacggtgcgcaagcggaggcgcccgacaaccaagggtcacattcaaacgtggcaggagcgaggcttaacaatgcgggtattgaggacctgcatggagacggcacggatgcgacgtcacccccctctgttcccggtgagctctgtgactcgtcagcatcaatgcagatccatgacgccggtggtttggatgtgacctctgccgtgtccgatgaggtggacgggggcgacagggtgactcatggcagtctgtcccagggtggtgccgatgctgagggcgacgaactggaatccaaacgaaggaagctggagtcttacaccatcgatatgagcaccgcctcaagagctgttcgcgagccccgcgtggtgatccagacgacaagcgaggtggacatcctcgatgatggctaccgctggcgcaagtacgggcagaaggtcgtgaagggcaatccaaatccaaggagctactacaagtgcacgcacccgggctgctcggtgcggaagcacgtggagcgcgcgtcgcacgacctcaagtccgtgatcaccacgtacgagggcaagcacaaccacgaggtcccggctgccaggaacagcggccacccgagcactgcaacggcgacgggcgcggccgccgcgcgcaggccggaacacccatctgcgcatgacggcctgatgaggcacctgggcagctgcggtgcgccgttcgccctgccactgccgtctcgggatccgctggcgccgatggtcaactacccggcgtacgcctccgccgccctcggtggcagcggcggctctgggttgctgccgagcctgctcatgcccggaggaggacccctcgggcaggtcgaggggctgaagctgcccatgctggcgcagtcttcgctgcagcagcagcacccgctgctgaggcaccggcaggcgatgcaggccgccgggctcgtggcgcccaaggcggcggacgtgaaggtcgagggcgccggtgccgcggcgccgtcggtgtaccagctgatgcgcaacgggctgccgctgggccaccagatg

SEQ ID NO: 1330 - protein, 678 aa, Setaria italica
  Si012785m polypeptide
MEEWKDPNPPESLMRGFQTGTFPPDAEVAKAGFEKEGRSLPMTPQFGQKSSPGSSLAERMQARAGFRVPKLSMPFSTAVGADNSVPGAPSPYLTIPPGLSPATLLDSPVFISNGMGQTSPTTGKLFRLGGTNDNDPIRFGGSPLGAGPDSFSFKPLDLKSSLYTAEGKKPPLPSTHVSVKTETKIQPVQEANLLGKLNQQNQSGQTNLKSGSHDSKLSRLAPVTGAGNEHVSSPHGQPMEEGDARGGDYTAIATSTPAEDGYSWRKYGQKQVKHSEYPRSYFKCTHLNCQVKKKVERSHEGHITEIIYKGTHNHPKPTQSRRPGVPPLHPFGDGAQAEAPDNQGSHSNVAGARLNNAGIEDLHGDGTDATSPPSVPGELCDSSASMQIHDAGGLDVTSAVSDEVDGGDRVTHGSLSQGGADAEGDELESKRRKLESYTIDMSTASRAVREPRVVIQTTSEVDILDDGYRWRKYGQKVVKGNPNPRSYYKCTHPGCSVRKHVERASHDLKSVITTYEGKHNHEVPAARNSGHPSTATATGAAAARRPEHPSAHDGLMRHLGSCGAPFALPLPSRDPLAPMVNYPAYASAALGGSGGSGLLPSLLMPGGGPLGQVEGLKLPMLAQSSLQQQHPLLRHRQAMQAAGLVAPKAADVKVEGAGAAAPSVYQLMRNGLPLGHQM

SEQ ID NO: 1331 - DNA, 1659 bp, Citrus clementina
  clementine0.9_006525m
atggccggattcctaatgctatttgttaaacattttcattttctgtctgttgaatattgtttgactagtacttacagatttacttttactcatcctcagcagtcctttcctagtattgaggtttctgttcagtctgagaattccccccaaaatgtaaatgcagccaaagtccattctcaatacagaaacagcctcagcctccaagtccaaacagacttctccagagcaacaactgaaaaggataatgggtgtaataccatcttggctgatcaaagggtctttgatacttttggtggcagtactgaacattctccacctcttgatgagcaacaggatgaagaaggagatcaaagaggcagtggagattccatggttgctggtgctggaggtgcatcatctgaagatggatataattggagaaaatatggacaaaaacaggtgaagggtagtgagtatccgcgtagttattacaagtgcacacatccaaactgtcaggttaagaagaaagtggagagatctcttgaaggccacataactgagatcatatacaaaggagctcataatcaccccaagcctccacccaatcgccgatcagccattgggtctaaccctcttgacatgcaattagacattcatgaacaggctggactgcagagtggtgctgatggtgatccctcatgggcaaatacacagaaagggactgctggtggaactcccgagtggaggcatgacactgtcgaggtgacatcagcagcacctgtgggacctgaatactgcaaccaatcttctgctttgcctgctcagaatggcactccctacgaatcaggtgatgcagtggatgcctcatctaccttctctaatgatgaagatgaagatgatcaggtgacacactgcagcgtaggttttgatggtgaagaagacgaatctgagtcaaagagaaggaaaattgaagcttatgcaacagaaatgagtggagccactagagctattcgtgagcctagagtagtggttcagacaacgagtgaggtagatatccttgatgatggataccgctggcgcaaatatgggcaaaaagttgtgaaaggaaatccaaatccaaggagttattacaagtgcacaagtgcaggctgcacggtgagaaagcacgtggagagggcgtcccatgatctgaagtcagtgatcaccacatatgagggaaagcacaaccatgatgttcccgctgctcgaaatagcagtcatgttaactctggctcctcaagtgccgtttctgcccatgctgctgctggtggtcaaatccacaggcccgagccatcacagcttcacaacagcatggcaagatttgacagacctgcttcttttggttctttcagagtacctggaaggcagcagttcggaccttcccctggcttctcatttggaatgcatcaaccaggcctggccaatctatctatggcaggacttggccccggccaacctgagctgcctgttttgcctgttcatccatatttggcacagcaacgccaggttaatgaaatgggtttcatgatgccaaaaggagaaccaaaggtggagccaatgtcggaacctggtctgaacttgtcgaatcgttcagcagtttaccagcagctgatgagtaggctacctcttggacctcagatg

SEQ ID NO: 1332 - protein, 553 aa, Citrus clementina
  clementine0.9_006525m polypeptide
MAGFLMLFVKHFHFLSVEYCLTSTYRFTFTHPQQSFPSIEVSVQSENSPQNVNAAKVHSQYRNSLSLQVQTDFSRATTEKDNGCNTILADQRVFDTFGGSTEHSPPLDEQQDEEGDQRGSGDSMVAGAGGASSEDGYNWRKYGQKQVKGSEYPRSYYKCTHPNCQVKKKVERSLEGHITEIIYKGAHNHPKPPPNRRSAIGSNPLDMQLDIHEQAGLQSGADGDPSWANTQKGTAGGTPEWRHDTVEVTSAAPVGPEYCNQSSALPAQNGTPYESGDAVDASSTFSNDEDEDDQVTHCSVGFDGEEDESESKRRKIEAYATEMSGATRAIREPRVVVQTTSEVDILDDGYRWRKYGQKVVKGNPNPRSYYKCTSAGCTVRKHVERASHDLKSVITTYEGKHNHDVPAARNSSHVNSGSSSAVSAHAAAGGQIHRPEPSQLHNSMARFDRPASFGSFRVPGRQQFGPSPGFSFGMHQPGLANLSMAGLGPGQPELPVLPVHPYLAQQRQVNEMGFMMPKGEPKVEPMSEPGLNLSNRSAVYQQLMSRLPLGPQM

SEQ ID NO: 1333 - DNA, 2283 bp, Glycine max
  Glyma04g12830.1
atggctgggattgatgataatgttggccttactggtgattggggtcttgctagcccaagtccaaggacctttttttccagaatgttcgaagaagatagtgtgacaagatcaatctcagaacattctggaagtggtagaactggggatctcttttcgggacatcgtgagcctagtgagacagggaaagaaaacatgaatgatagggcacaagatggtgattctggagcccaattgaccgatgtgagttttcagaccgagcagaagtcgagctcccggggtggtcttgttgaaagaatggctgctagagccgggtttaatgctccaaggttgaatacagaaagcattagatctactgacctttcgcttaatcccgacattcagtctccgtacttgacaatcccgcctggtctcagtcctactacacttttagattctccagtgttccttgcaaattcactggcacagccttctccaactaccggaaagttcttgttcatggcaaatggcatcatgaggaactcagaattatcatctgatgctccagaaaaatgtaaagataatggctttgatgatatctacacatcatcctttgctttcaagcgtgcaacagattcaggctctttttatcatggtgctggaagaaaaatgataaatcctactacacttcctcaacagtcccttcctggtattgaggtttcggctcagtctgaaaattcttttcaatctcaaagtgttgatgctgtcaaagctcaaactgagaacaaaagtggttttcgtcttcaggccgactttgctgaatcacctcctcaaaaagataatggaattaagatgttctcagctgatcaaagggcttttgatgttgttggcggtggcaatgaacattctacaccaattgaagagcaagtagatgaaggagatcaaagaggcaatggagactcaatggctagtggtgttggtggtgcaccatctgaagatggatataactggagaaaatatggccaaaagcaagtgaagggcagcgagtaccctcgaagttactacaagtgtacgcatccaaactgtcaagtgaagaagaaagtagaaagatctcatgagggccacataactgagatcatctacaagggaacacacaaccatccaaaacctcctccaaatcgtcggtcaggtataggtttggttaaccttcatactgacatgcaagtggaccaccctgaacatgttgaaccacacaacggtggtgatggcgacttgggatgggctaatgtacaaaagggaaacatagctggagctgctagttggaagcatgacaaccttgaagccgcttcatcagcatccgttggccctgaatactgcaaccagcagccccccaatttgcagactcaaaatggtactcactttgattcaggagaggcagtggatgcctcatctactttttctaacgaagaagatgaagacgatcaaggcactcatggtagtgtatcattaggttatgatggggaaggagatgaatctgagtctaagagaaggaaactggaatcatatgcagagttgagtggagctactagagccattcgtgagcctagagttgttgtacagactaccagcgaagtagatatcctcgatgatggttatcggtggcggaaatatggacaaaaagttgtcaaaggaaatcccaacccaaggagttactacaagtgcacaaatgcagggtgcacagtaaggaagcatgtggagagagcatcacatgaccttaaatctgtgatcactacgtatgagggaaagcacaaccatgatgttccagctgctcgtgccagcagtcacgtcaatgctaatgcttccaatgcagttcctggccaagcttctcttcagacccatgttcacagacctgaaccatctgaagttcacaacggcattggaaggcttgagaggccttccctgggctcattcaacctacccgggaggcagcaactaggaccttcccatggcttctccttcggtatgaaccaatccatgctatcaaatctggtgatgtcagggttgggccatgcgcaagcaaagcttcctgtcatgcctgttcattcattcttggcagcgcatcaacaacaacagcaacatcaacaacaacaaaaccaacaacaacgtgcggcaaatgatttgggtttcatgttgccaaagggagagccaaatgtggaggctattcctgaacgtggtggccttaacctgtcaaatggctcatcagtgtaccaagaaattatgagccgcatgcctcttggacctcatatg

SEQ ID NO: 1334 - protein, 761 aa, Glycine max
  Glyma04g12830.1 polypeptide
MAGIDDNVGLTGDWGLASPSPRTFFSRMFEEDSVTRSISEHSGSGRTGDLFSGHREPSETGKENMNDRAQDGDSGAQLTDVSFQTEQKSSSRGGLVERMAARAGFNAPRLNTESIRSTDLSLNPDIQSPYLTIPPGLSPTTLLDSPVFLANSLAQPSPTTGKFLFMANGIMRNSELSSDAPEKCKDNGFDDIYTSSFAFKRATDSGSFYHGAGRKMINPTTLPQQSLPGIEVSAQSENSFQSQSVDAVKAQTENKSGFRLQADFAESPPQKDNGIKMFSADQRAFDVVGGGNEHSTPIEEQVDEGDQRGNGDSMASGVGGAPSEDGYNWRKYGQKQVKGSEYPRSYYKCTHPNCQVKKKVERSHEGHITEIIYKGTHNHPKPPPNRRSGIGLVNLHTDMQVDHPEHVEPHNGGDGDLGWANVQKGNIAGAASWKHDNLEAASSASVGPEYCNQQPPNLQTQNGTHFDSGEAVDASSTFSNEEDEDDQGTHGSVSLGYDGEGDESESKRRKLESYAELSGATRAIREPRVVVQTTSEVDILDDGYRWRKYGQKVVKGNPNPRSYYKCTNAGCTVRKHVERASHDLKSVITTYEGKHNHDVPAARASSHVNANASNAVPGQASLQTHVHRPEPSEVHNGIGRLERPSLGSFNLPGRQQLGPSHGFSFGMNQSMLSNLVMSGLGHAQAKLPVMPVHSFLAAHQQQQQHQQQQNQQQRAANDLGFMLPKGEPNVEAIPERGGLNLSNGSSVYQEIMSRMPLGPHM

SEQ ID NO: 1335 - DNA, 2058 bp, Glycine max
  Glyma06g47880.1
atggctgggattgatgataatgttgcccttactggtgattggggtcttgctagcccaagtccaaggacctttttttccagaatgttagaagaagatatggtagaactggggatcccttttcgggacatcgcgagcctaaccgagcagaagccgagctctcggggtggtcttgttgaaagaatggctgctagagctgggtttaatgctccgaggttgaatacagaaagcattagatctactgacctttcacttaattccgacattcagtctccttacttgaccatcccacctggtctcagtcctactacacttttagattctccagtgttccttgcaaattcactggcacagccatctccaacaaccggaaagttcctgttcatggttaatggcaacatgcggcactcagaattatcatctgatgctccagaaaaatgtaaacacaatggctttgatgatatctacacatcatcctttgctttcaagcctgcaacagattcaggctcctctttttatcatggtgctggaagaaaaataaatccaactacacttcctcaacaatcccttcctggtgttgaggtttcggctcagtctgaaaattcttttcaatgtcaaagtgttgatgctgtcaaagctcaaactgagaacaaaagtggccttcatcttcaggaagactttgttgaatcgcctcctcaaaaagataatggaattaaaatgttctcagccaatcaaagggcttttcatgctgttggcagtggcattgaacattctacaccagttgaagagcaagcagatgaagaaggagatcaaagagtcaatggagattcaatggctggtggtgttggtgcaccatctgaagatggatataactggagaaaatatggccaaaagcaagtgaagggcagcgagtacccacggagttactacaagtgtactcatccgaactgtcaggttaagaagaaagtagaacgatctcatgagggccacataactgagatcatctacaagggaacgcacgaccatgcaaaacctcctccaaatcgccggtcaagtataggttcggttaaccttcatactgacatgcaagtggacaaccctgaacacgttgaaccacacaatggtggtgatggtgacttgggctgggctaatgtacaaaagggaaatatagctggagctgctaattggaagcatgaaaacattgaagccacatcatcagcatctgttggccctgaatactgcaaccagtcccccaatttgcaggctcaaaatggtactcacttagattcaggagaggcggtggatgcctcatctactttttctaatgaagaagacgatcaagtcactcatggtagtgtatcattaggttatgatggggaaggagatgaatctgagtctaagagaaggaaactggaatcatatgcagagttgagtggagctactagagccattcgcgagcctagagttgttgtacagactaccagcgaagtagatatcctcgatgatggttatcggtggcggaaatatgggcaaaaagttgtcaaaggaaatcccaacccaaggagttactacaagtgcacgaatgcagggtgcacggtcaggaagcatgtggagagagcatcacatgaccttaaatctgtaatcacaacatacgagggaaaacataaccatgatgttcctgctgctcgtgccagcagtcacgtcaacgctaatgcttccaatgccgttcctggccaagcttctcttcagactcatgttcatagacccgaaccatctcaagttcacaatggcattggaaggcttgagaggccttctcttggctcattcaacctacccgggaggcagcaactaggaccatcccatggcttctcctttggtatgaaccaatccatgctatcaaatctggtgatgtcagggttaggccacgcgcaagcaaagcttcctgtcatgcctggagagccaaatgtggaggctattcctgaacatggtggccttaacctgtcaaatggctcatcagtgtaccaagaaatgatgagtcgcatgcctcttggacctcatatg

SEQ ID NO: 1336 - protein, 686 aa, Glycine max
  Glyma06g47880.1 polypeptide
MAGIDDNVALTGDWGLASPSPRTFFSRMLEEDMVELGIPFRDIASLTEQKPSSRGGLVERMAARAGFNAPRLNTESIRSTDLSLNSDIQSPYLTIPPGLSPTTLLDSPVFLANSLAQPSPTTGKFLFMVNGNMRHSELSSDAPEKCKHNGFDDIYTSSFAFKPATDSGSSFYHGAGRKINPTTLPQQSLPGVEVSAQSENSFQCQSVDAVKAQTENKSGLHLQEDFVESPPQKDNGIKMFSANQRAFHAVGSGIEHSTPVEEQADEEGDQRVNGDSMAGGVGAPSEDGYNWRKYGQKQVKGSEYPRSYYKCTHPNCQVKKKVERSHEGHITEIIYKGTHDHAKPPPNRRSSIGSVNLHTDMQVDNPEHVEPHNGGDGDLGWANVQKGNIAGAANWKHENIEATSSASVGPEYCNQSPNLQAQNGTHLDSGEAVDASSTFSNEEDDQVTHGSVSLGYDGEGDESESKRRKLESYAELSGATRAIREPRVVVQTTSEVDILDDGYRWRKYGQKVVKGNPNPRSYYKCTNAGCTVRKHVERASHDLKSVITTYEGKHNHDVPAARASSHVNANASNAVPGQASLQTHVHRPEPSQVHNGIGRLERPSLGSFNLPGRQQLGPSHGFSFGMNQSMLSNLVMSGLGHAQAKLPVMPGEPNVEAIPEHGGLNLSNGSSVYQEMMSRMPLGPHM

SEQ ID NO: 1337 - DNA, 1500 bp, Glycine max
  Glyma06g47880.2
atgttctcagccaatcaaagggcttttcatgctgttggcagtggcattgaacattctacaccagttgaagagcaagcagatgaagaaggagatcaaagagtcaatggagattcaatggctggtggtgttggtgcaccatctgaagatggatataactggagaaaatatggccaaaagcaagtgaagggcagcgagtacccacggagttactacaagtgtactcatccgaactgtcaggttaagaagaaagtagaacgatctcatgagggccacataactgagatcatctacaagggaacgcacgaccatgcaaaacctcctccaaatcgccggtcaagtataggttcggttaaccttcatactgacatgcaagtggacaaccctgaacacgttgaaccacacaatggtggtgatggtgacttgggctgggctaatgtacaaaagggaaatatagctggagctgctaattggaagcatgaaaacattgaagccacatcatcagcatctgttggccctgaatactgcaaccagtcccccaatttgcaggctcaaaatggtactcacttagattcaggagaggcggtggatgcctcatctactttttctaatgaagaagacgatcaagtcactcatggtagtgtatcattaggttatgatggggaaggagatgaatctgagtctaagagaaggaaactggaatcatatgcagagttgagtggagctactagagccattcgcgagcctagagttgttgtacagactaccagcgaagtagatatcctcgatgatggttatcggtggcggaaatatgggcaaaaagttgtcaaaggaaatcccaacccaaggagttactacaagtgcacgaatgcagggtgcacggtcaggaagcatgtggagagagcatcacatgaccttaaatctgtaatcacaacatacgagggaaaacataaccatgatgttcctgctgctcgtgccagcagtcacgtcaacgctaatgcttccaatgccgttcctggccaagcttctcttcagactcatgttcatagacccgaaccatctcaagttcacaatggcattggaaggcttgagaggccttctcttggctcattcaacctacccgggaggcagcaactaggaccatcccatggcttctcctttggtatgaaccaatccatgctatcaaatctggtgatgtcagggttaggccacgcgcaagcaaagcttcctgtcatgcctgttcatccgttcttggcagcgcaacaacaacatcaacagcgacaacaacatcaacagcagcagcaacatcaacagcagcagcaacaacatcaacagcaacagcaacatcaacaacaacaatgcgctgcaaatgatttgggtttcatgttgccaaagggagagccaaatgtggaggctattcctgaacatggtggccttaacctgtcaaatggctcatcagtgtaccaagaaatgatgagtcgcatgcctcttggacctcatatg

SEQ ID NO: 1338 - protein, 500 aa, Glycine max
  Glyma06g47880.2 polypeptide
MFSANQRAFHAVGSGIEHSTPVEEQADEEGDQRVNGDSMAGGVGAPSEDGYNWRKYGQKQVKGSEYPRSYYKCTHPNCQVKKKVERSHEGHITEIIYKGTHDHAKPPPNRRSSIGSVNLHTDMQVDNPEHVEPHNGGDGDLGWANVQKGNIAGAANWKHENIEATSSASVGPEYCNQSPNLQAQNGTHLDSGEAVDASSTFSNEEDDQVTHGSVSLGYDGEGDESESKRRKLESYAELSGATRAIREPRVVVQTTSEVDILDDGYRWRKYGQKVVKGNPNPRSYYKCTNAGCTVRKHVERASHDLKSVITTYEGKHNHDVPAARASSHVNANASNAVPGQASLQTHVHRPEPSQVHNGIGRLERPSLGSFNLPGRQQLGPSHGFSFGMNQSMLSNLVMSGLGHAQAKLPVMPVHPFLAAQQQHQQRQQHQQQQQHQQQQQQHQQQQQHQQQQCAANDLGFMLPKGEPNVEAIPEHGGLNLSNGSSVYQEMMSRMPLGPHM

SEQ ID NO: 1339 - DNA, 2253 bp, Eucalyptus grandis
  Eucgr.F01981.1
atgagtggggcagatgataatgttgccgtgattggtgattgggtgcctcccagtccaagcccaagaacctttttcaccgcgatgcttggtgatgacattggtttgaggtcaggactggaagcttctggaaacaataagacaggggggctttttctaggatctcaagagagggtgacgatgggaaactttgaaaacaaggacacaaaacgagtcggtcctagtggtggtgaccactccagtgaatctcgcttggctgtcgagcagaaagggtattcgcgtggatgtcttggggaaaggttggcagcccgagctgggtttaacgccccaagattaaatacagagggaattagatctgctgatctatcgtcgaatcctgatgttcggtctccttatttgacgatccctcctggtctaagtcctacaacacttctcgattccccagttttcctctcgaatacgctggctcagccctctccgaccacaggaaagttccctttcattcataacaataatagcaggagctccgggttgatgttagatgcaaatacaagtaaagataacccatttgaggagaacagttcttcatcctttgctttcaagcctcttggggaggcgagttcgtccttttttggtgctgggagcaaaatgaatcaagctacatttcctcagcagtcttaccacagaatcgaggtttcagttcagtcagaaaattctgtccaatctcgtaatgtggaagcaaccaaattgcaatcccagaatggaagtggcttccaatttcagggagacttttccaggtcatcagcagaaaatgttgctggtcatgatggggtgccatctgatcaaaggaacttcagtactgttactggtgatcctgaacattctccgccgctggacgagcaacaggatgatgaaggagaccaaagaatcagcggagattccttggtaggtgttaatggtggcagcccttctgaagatggatataactggagaaaatatggacagaaacaagtcaagggaagcgagtatccaagaagttattacaagtgcactcatcccagctgtcaagtaaaaaagaaggtggaacgatctcatgagggccatattacagaaatcatctacaagggggcccacaatcacccgaaacctccaccgaaccgccgatctgtcattgggggagctaatccctttggtgacatgcagttggacaatccagaacagatgggcttgcagaatgctacggacactgatcctgcttgggctaatatgcagaaaactgctggtatgggaggatcagagtggaggcaggataaccttgaggtcacatcatcaccatctgatggccccgaatttagcaatgctccgacctctttacaggcacagaatggtggtaatcaattggaatcaggggatcaggtggatgcgtcctctactttttcaaatgatgaatgtgatgatgagcagcagacgcacggtagtgtatctttggcttatgatggagaagaagatgaatctgattcaaagagaaggaaaattgaagcctatgcaactgatatgagtggggcttcaagagccattcgtgagccgagagttgtggtccagacgaccagtgaggtagatattcttgacgatggttatcgctggcgcaagtatggacagaaagttgtgaagggaaacccgaacccaaggagttactacaagtgcacaagtcctggctgcacggttaggaagcacgtagagagggcgtcacatgaccttaagtcagtaattactacgtatgaagggaagcataatcatgatgttcctgctgctcggaatagcagccatgtcaactctggcgcatcaagcgctataccaacccagtgcaccacctctgcagttcagactcaggtccataggccggagccctcacaagtccatagcatgatggggaggtatgaggggcccgggtcattgggttcgtttagcctacctggaagacagcaactaggccctggtcccggattttccttcgcaatgaatccacccagactggcgaattttgcaatggctgggatgggtcctggccagggcaatcttccgatgttgcctgttcatccatttctggctcagcagcaccaagtacatgaaatgggattcatgttaccgaaaggagaaccaaaggctgagccaatgtctgagcctggtccaaacttgtctaacaactcctcggtttatcagcatattatgagtagactgccgcttggacctcagatg

SEQ ID NO: 1340 - protein, 751 aa, Eucalyptus grandis
  Eucgr.F01981.1 polypeptide
MSGADDNVAVIGDWVPPSPSPRTFFTAMLGDDIGLRSGLEASGNNKTGGLFLGSQERVTMGNFENKDTKRVGPSGGDHSSESRLAVEQKGYSRGCLGERLAARAGFNAPRLNTEGIRSADLSSNPDVRSPYLTIPPGLSPTTLLDSPVFLSNTLAQPSPTTGKFPFIHNNNSRSSGLMLDANTSKDNPFEENSSSSFAFKPLGEASSSFFGAGSKMNQATFPQQSYHRIEVSVQSENSVQSRNVEATKLQSQNGSGFQFQGDFSRSSAENVAGHDGVPSDQRNFSTVTGDPEHSPPLDEQQDDEGDQRISGDSLVGVNGGSPSEDGYNWRKYGQKQVKGSEYPRSYYKCTHPSCQVKKKVERSHEGHITEIIYKGAHNHPKPPPNRRSVIGGANPFGDMQLDNPEQMGLQNATDTDPAWANMQKTAGMGGSEWRQDNLEVTSSPSDGPEFSNAPTSLQAQNGGNQLESGDQVDASSTFSNDECDDEQQTHGSVSLAYDGEEDESDSKRRKIEAYATDMSGASRAIREPRVVVQTTSEVDILDDGYRWRKYGQKVVKGNPNPRSYYKCTSPGCTVRKHVERASHDLKSVITTYEGKHNHDVPAARNSSHVNSGASSAIPTQCTTSAVQTQVHRPEPSQVHSMMGRYEGPGSLGSFSLPGRQQLGPGPGFSFAMNPPRLANFAMAGMGPGQGNLPMLPVHPFLAQQHQVHEMGFMLPKGEPKAEPMSEPGPNLSNNSSVYQHIMSRLPLGPQM

SEQ ID NO: 1341 - DNA, 2193 bp, Populus trichocarpa
  POPTR_0001s47670.1
atggctgggattgatgataatgttgctataattggtgactgggtacctcctagtccaagcccaagagcatttttctcagtaatgttaggtgacgatattaactcaagtacaatcacagaaccccctggggagaatagaactaaagggctctttctgggacaaccagagcagatgacaacaggaaatgccgaaaaaaaagatggagcacgaactagtggtgcccagttgactgaattgggttcattttctgagcaaaaatcaaactcacgtggaggtctcgttgaaagaatggcagccagagctggatttaatgctccaaggttgaatacagaaagtatcaggtctgctgaaacttcactgaaccctgagattaggtctccttatttgacaataccacctggtctcagcccgacaaccttgctggaatctccagttttcctttcaaacttggctcagccatctccaactactggaaagttttcattttttccaaatggtagcagtaagaactccacagcgggctccaaacttcctgacaatagtaaagaaactttcttcgaagacatcaattcatcttcgttcgcattcaagcctatgggagaatcgggctcttcatttttccttggtggaacaagcaagcaatcctttcccagtatggatgtttctgttcactctgaaaatgctcttcagtcacatgatgttgcacccgccaaagttcagtctgagagtagaaactcccttcattttccagcagaattcttcaaattgacaactgaaaaggataatggaggaaataccgtagcagatcagaggacttttgatactgttggtggcaatgctgagcattcttctcctcttgatgagcaacaagatgaagaaggagatcaaagagccagtggagattcaatggctgctggtggcacgccatctgacaagggatataattttagaaaatatggacaaaaacaagtaaaaggaagtgaatatccacggagttattacaagtgcactcatccaaattgctcagttaagaagaaagtggaacgttctctcgagggccatataacagagatcatatacaagggggcacacagccatcccaagccgctacccaaccggaggtcagctgttggatcactggatacacaactggacattcctgaacaagttgttccacagattggttctgttaatgattcggcttgggcaggtacacaaaagggaattgctgcagggacttctgattggaggcgtgacaatgtcgaggttacatcttcagcatctgggggcccaggccctgaatttgggaatccatcctcctcggtacaggctcagagtggaactccctttgagtcagctgatgccattgatgcctcatctaccttttcaaatgatgaagatgatgatcgggctacacatggcagtgtaggttacgatggtgaaggagaagaatctgagtcgaagagaaggaaaattgaaacatatgcaactgaaatgagtggagccaccagagctattcgtgagcctagagttgtggtccagacaaccagtgaggtggatatccttgatgatggatatcgctggcgaaagtatgggcagaaagttgtgaaaggaaatccaaatcctaggagttattacaagtgtactagtgcaggctgcacggttagaaagcatgtggagagggcatcacatgatctcaagtcagtgatcactacgtatgaggggaagcacaatcatgatgttcctgctgctcgcaatagcagccatgtgaactctggcacctccaatgccaccccaggccaagctgctgttgctgttcaaacccatgttcacagacatgagtcatcacaggttcacaacagcatggctaggtttgagcggcctcctgcatttggatccttcagcctgcctggaaggcagcagctggggccttcgcctggcttctcatttggaatgaatcaacctggcttggccaatcttgcaatggctggcttaggtcagggccaaccaaagatgcctgttatgcccattcatccatacttggcgcagcaacatcctgggaacgaaatggggttcatgatgccgaaagaagaaccaaaggtggggcctgtgacagaacctagtctgaacctctccaacaatcgaacactgtatcagcaaatcatgagtaggctgcctcttgggcctcagatg

SEQ ID NO: 1342 - protein, 731 aa, Populus trichocarpa
  POPTR_0001s47670.1 polypeptide
MAGIDDNVAIIGDWVPPSPSPRAFFSVMLGDDINSSTITEPPGENRTKGLFLGQPEQMTTGNAEKKDGARTSGAQLTELGSFSEQKSNSRGGLVERMAARAGFNAPRLNTESIRSAETSLNPEIRSPYLTIPPGLSPTTLLESPVFLSNLAQPSPTTGKFSFFPNGSSKNSTAGSKLPDNSKETFFEDINSSSFAFKPMGESGSSFFLGGTSKQSFPSMDVSVHSENALQSHDVAPAKVQSESRNSLHFPAEFFKLTTEKDNGGNTVADQRTFDTVGGNAEHSSPLDEQQDEEGDQRASGDSMAAGGTPSDKGYNFRKYGQKQVKGSEYPRSYYKCTHPNCSVKKKVERSLEGHITEIIYKGAHSHPKPLPNRRSAVGSLDTQLDIPEQVVPQIGSVNDSAWAGTQKGIAAGTSDWRRDNVEVTSSASGGPGPEFGNPSSSVQAQSGTPFESADAIDASSTFSNDEDDDRATHGSVGYDGEGEESESKRRKIETYATEMSGATRAIREPRVVVQTTSEVDILDDGYRWRKYGQKVVKGNPNPRSYYKCTSAGCTVRKHVERASHDLKSVITTYEGKHNHDVPAARNSSHVNSGTSNATPGQAAVAVQTHVHRHESSQVHNSMARFERPPAFGSFSLPGRQQLGPSPGFSFGMNQPGLANLAMAGLGQGQPKMPVMPIHPYLAQQHPGNEMGFMMPKEEPKVGPVTEPSLNLSNNRTLYQQIMSRLPLGPQM

SEQ ID NO: 1343 - DNA, 2172 bp, Populus trichocarpa
  POPTR_0001s47670.2
atggctgggattgatgataatgttgctataattggtgactgggtacctcctagtccaagcccaagagcatttttctcagtaatgttaggtgacgatattaactcaagtacaatcacagaaccccctggggagaatagaactaaagggctctttctgggacaaccagagcagatgacaacaggaaatgccgaaaaaaaagatggagcacgaactagtggtgcccagttgactgaattgggttcattttctgagcaaaaatcaaactcacgtggaggtctcgttgaaagaatggcagccagagctggatttaatgctccaaggttgaatacagaaagtatcaggtctgctgaaacttcactgaaccctgagattaggtctccttatttgacaataccacctggtctcagcccgacaaccttgctggaatctccagttttcctttcaaacttggctcagccatctccaactactggaaagttttcattttttccaaatggtagcagtaagaactccacagcgggctccaaacttcctgacaatagtaaagaaactttcttcgaagacatcaattcatcttcgttcgcattcaagcctatgggagaatcgggctcttcatttttccttggtggaacaagcaagcaatcctttcccagtatggatgtttctgttcactctgaaaatgctcttcagtcacatgatgttgcacccgccaaagttcagtctgagagtagaaactcccttcattttccagcagaattcttcaaattgacaactgaaaaggataatggaggaaataccgtagcagatcagaggacttttgatactgttggtggcaatgctgagcattcttctcctcttgatgagcaacaagatgaagaaggagatcaaagagccagtggagattcaatggctgctggtggcacgccatctgacaagggatataattttagaaaatatggacaaaaacaagtaaaaggaagtgaatatccacggagttattacaagtgcactcatccaaattgctcagttaagaagaaagtggaacgttctctcgagggccatataacagagatcatatacaagggggcacacagccatcccaagccgctacccaaccggaggtcagctgttggatcactggatacacaactggacattcctgaacaagttgttccacagattggttctgttaatgattcggcttgggcaggtacacaaaagggaattgctgcagggacttctgattggaggcgtgacaatgtcgaggttacatcttcagcatctgggggcccaggccctgaatttgggaatccatcctcctcggtacaggctcagagtggaactccctttgagtcagctgatgccattgatgcctcatctaccttttcaaatgatgaagatgatgatcgggctacacatggcagtgtaggttacgatggtgaaggagaagaatctgagtcgaagagaaggaaaattgaaacatatgcaactgaaatgagtggagccaccagagctattcgtgagcctagagttgtggtccagacaaccagtgaggtggatatccttgatgatggatatcgctggcgaaagtatgggcagaaagttgtgaaaggaaatccaaatcctaggttttattacaagtgtactagtgcaggctgcacggttagaaagcatgtggagagggcatcacatgatctcaagtcagtgatcactacgtatgaggggaagcacaatcatgatgttcctgctgctcgcaatagcagccatgtgaactctggcacctccaatgccaccccaggccaagctgctgttgctgttcaaacccatgttcacagacatgagtcatcacaggttcacaacagcatggctaggtttgagcggcctcctgcatttggatccttcagcctgcctggaaggcagcagctggggccttcgcctggcttctcatttggaatgaatcaacctggcttggccaatcttgcaatggctggcttaggtcagggccaaccaaagatgcctgttatgcccattcatccatacttggcgcagcaacatcctgggaacgaaatggggttcatgatgccgaaagaagaaccaaaggtggggcctgtgacagaacctagtctgaacctctccaacaatcgaacactgtatcagcaaatcatgagaaaa

SEQ ID NO: 1344 - protein, 724 aa, Populus trichocarpa
  POPTR_0001s47670.2 polypeptide
MAGIDDNVAIIGDWVPPSPSPRAFFSVMLGDDINSSTITEPPGENRTKGLFLGQPEQMTTGNAEKKDGARTSGAQLTELGSFSEQKSNSRGGLVERMAARAGFNAPRLNTESIRSAETSLNPEIRSPYLTIPPGLSPTTLLESPVFLSNLAQPSPTTGKFSFFPNGSSKNSTAGSKLPDNSKETFFEDINSSSFAFKPMGESGSSFFLGGTSKQSFPSMDVSVHSENALQSHDVAPAKVQSESRNSLHFPAEFFKLTTEKDNGGNTVADQRTFDTVGGNAEHSSPLDEQQDEEGDQRASGDSMAAGGTPSDKGYNFRKYGQKQVKGSEYPRSYYKCTHPNCSVKKKVERSLEGHITEIIYKGAHSHPKPLPNRRSAVGSLDTQLDIPEQVVPQIGSVNDSAWAGTQKGIAAGTSDWRRDNVEVTSSASGGPGPEFGNPSSSVQAQSGTPFESADAIDASSTFSNDEDDDRATHGSVGYDGEGEESESKRRKIETYATEMSGATRAIREPRVVVQTTSEVDILDDGYRWRKYGQKVVKGNPNPRFYYKCTSAGCTVRKHVERASHDLKSVITTYEGKHNHDVPAARNSSHVNSGTSNATPGQAAVAVQTHVHRHESSQVHNSMARFERPPAFGSFSLPGRQQLGPSPGFSFGMNQPGLANLAMAGLGQGQPKMPVMPIHPYLAQQHPGNEMGFMMPKEEPKVGPVTEPSLNLSNNRTLYQQIMRK

SEQ ID NO: 1345 - DNA, 2175 bp, Populus trichocarpa
  POPTR_0011s17230.1
atggctgggattgatgataacgttgctataattggtgattgggtacctcctagtccaagtccaagagcttttttctcagcaatgttaggtgatgatattaactcaagaacaatcccagaatctcctggggagaaaagaaatgaagggctctatctgggacaaccagagcagatggcaacaggaaattctgagaaaaaggatggagcacaaactagtggtgttcagttgactgaattaggtacattttctgagcaaaaatcaaactttcgtggaggtcttgttgaaagaattgcagccagagctggatttaatgcaccgcggttgaatacagaaagtatcaggtccactgaaagttctatgaaccctgagattaggtcgccttatttgacaataccacctggtctcagcccgacaaccttgctggaatctccagttttcctttcaaatttggcacagccatctccaacaactggaaaattttctttttttccaaatggtaacaccaagaactccacagtgggctctgaccctcctgataaaagtaaagaaactttctttgacaacattgattcatcttcatttgcgttcaagcctatgggagaatcaggttcttttttccttggtggaacaagcaagcaatcctttcccagtatcgatgtttctgttcactctgagaatgcttttcagtcgcatggtgtggaacccgccaaaactcagtttgagagtagaaacagcctccatttccgagcagaattctccaaattgactactgaaaaggataatggatgtattactgtagcagatcagaggacctttgacactgttgctggcaacgccgagcattcttcccctcttgctgagcaacaagatgaagaaggagatcaaagagccagtgaagattcaatggctgctggaggcacaccatctgaggatgcatataattggagaaaatatgggcagaaacaagtaaaaggcagtgagtatccacggagttattacaagtgcacgcatccaaattgcccagttaagaagaaagtggaacgttctcatgagggccatataacagagatcatatataagggggcacacaaccatcccaagccaccacccaaccggaggtcagccactggatcaatggatacacaactggatattcctgaacaagctgggccacaggttggtgctgttaatgattcggtttgggcaggtacacaaaaaggaactgctgcaggaactcctgattggaggaatgacaatgtcgaggtttcatcttcagcatctgggggcctaggccctgaattcgggaatccatcttcctcggtacagggtcagagcggaactccctttgagtcagctgatgctgtggatgcctcgtctaccttttcaaatgatgaagatgatgatcgggctacacatggcagtgtaggttatgatggtgaaggagaagaatctgagtccaagagaaggaaagttgaaacatatgcaaccgaaatgagtggagccaccagagcaatccgtgagcctagagttgtggtccagacaaccagtgaggtggatatccttgacgatggatatcgctggagaaagtatggacagaaagttgttaaaggaaatccaaatcctaggagttattacaagtgcactagcgcaggctgcacagtgagaaagcatgtggagagggcatcgcatgaccttaagtcagtgatcactacgtatgaggggaagcacaatcatgatgtccctgctgctcgcaatagcaaccatgtcaactctggcacctctaatgccacaccagcccaagctggcatcgcagttcaaacccaagttcacagacctgaggcatcccaagttcacaacagcatgactagtagatttgagaggcctcctgcatttggatccttcaggcagcagctggggccttcggctggcttctcatttggaatgaatcaacctgggtttgccaatatgggaatggctgggttaggtccagggcaaccaaggatgccagttatgcccatgcatccatacttagcacagcaacgtgcagtgaatgaaatggggttgatgatgccgaaaggagaagcaaaggtggagccagtgactgaagctaatatgagcctgtcctccaacaatccaacagtgtatcagcaaataatgagtaggctgcctcagatg

SEQ ID NO: 1346 - protein, 725 aa, Populus trichocarpa
  POPTR_0011s17230.1 polypeptide
MAGIDDNVAIIGDWVPPSPSPRAFFSAMLGDDINSRTIPESPGEKRNEGLYLGQPEQMATGNSEKKDGAQTSGVQLTELGTFSEQKSNFRGGLVERIAARAGFNAPRLNTESIRSTESSMNPEIRSPYLTIPPGLSPTTLLESPVFLSNLAQPSPTTGKFSFFPNGNTKNSTVGSDPPDKSKETFFDNIDSSSFAFKPMGESGSFFLGGTSKQSFPSIDVSVHSENAFQSHGVEPAKTQFESRNSLHFRAEFSKLTTEKDNGCITVADQRTFDTVAGNAEHSSPLAEQQDEEGDQRASEDSMAAGGTPSEDAYNWRKYGQKQVKGSEYPRSYYKCTHPNCPVKKKVERSHEGHITEIIYKGAHNHPKPPPNRRSATGSMDTQLDIPEQAGPQVGAVNDSVWAGTQKGTAAGTPDWRNDNVEVSSSASGGLGPEFGNPSSSVQGQSGTPFESADAVDASSTFSNDEDDDRATHGSVGYDGEGEESESKRRKVETYATEMSGATRAIREPRVVVQTTSEVDILDDGYRWRKYGQKVVKGNPNPRSYYKCTSAGCTVRKHVERASHDLKSVITTYEGKHNHDVPAARNSNHVNSGTSNATPAQAGIAVQTQVHRPEASQVHNSMTSRFERPPAFGSFRQQLGPSAGFSFGMNQPGFANMGMAGLGPGQPRMPVMPMHPYLAQQRAVNEMGLMMPKGEAKVEPVTEANMSLSSNNPTVYQQIMSRLPQM

SEQ ID NO: 1347 - DNA, 1866 bp, Vitis vinifera
  GSVIVT01014854001
atggcgggtattgatgaccatgttgctataattggagattgggtgcctcccagtccaagcccgagaatgttcttctcaatgatgctaggtgatgatgttgactcaagagcaacctctgaacctaccaacgaaaatagaaatgaggctggtgacttgggtgatcaattgactgaattcggtgcattttctgatcagaaattaagctcacggggaggtcttgtggaaaggatagcagccagagctggatttaatgctccaaggttgaatacagaaagtatcagatctgctgacctgtcattgaaccctgatgttcggtctccttacctgacaatccctcctggtctcagtccaactacactgctagaatctccagtttttctctcgacttcacatgctcaaccctctccaacaacgggaaaattcccatttattccaaatgttaacaataggagctccatgttgatcccagcggcccctgataggagtaaagaagatctgtttgaggacttcaatacctcatcttttgcattcaagcctgttgcagaatcgggttcctccttttttaataatggagccagcaaaatatctgctgcgaccattccacagcaatcatttcctagtattgaggtctcagttcagtcagagaactctctaccttctcaaattatggaacctaccaaagtccactctcagattggcagtgctgaacattctccaccacttgatgagcaacaagatgaggatggagatcaaaggggtggtgtagacaacatggttggtggtgccccagccgaggatggatataattggagaaaatatggacagaagcaagtaaaaggcagcgaatttccacgaagttattacaagtgcacgcatccaaattgtcaagttaagaagaaggtggaacggtctcatgaaggccacataacagagatcatctacaagggagcccacaatcactccaaacctccacccaatcgccgatcagccattgggtcatctaatccactcagtgacatgcagctagatataccagaacaggcagggccacatggtggtgatggtgatccaggtcagaatggtgctccttttgaatcaagtgatgcagtggatgcctcatccaccttttctaatgatgaagatgatgatgatcgagtgacacatggcagtgtatcattgggttatgatggtgaaggagatgaatctgaatcaaagagaaggaaagtcgaagcttatgcaacagaaatgagtggagccaccagagcaattcgtgagcctagagttgtggttcagacaaccagtgaggtggatatccttgatgatggatatcgctggcgcaagtatgggcagaaagtcgtgaaaggaaatccgaatccaaggagttactacaagtgcaccaatgcaggctgcacagtaaggaagcatgtggagagggcatcacatgaccttaagtcagttataaccacatatgaagggaagcacaatcatgatgttcctgctgctcgcaatagcagccatgtcaactctgttcataacatggcgaggtttgacaggcctccttcatttggtacattcaacctgcctggaaggcagcagctggggccttcccatggtttctctttcgggatgaatcaaccaggcctggccaatcttggaatggctggcttgggccctacccaaggcaagctgcctgctctgccggttcatccatatctgggacagcaacgccaggtgaatgaaatgggtttcatgttgccaaaaggagaaccaaaggtggagcccatgtcagaacccagtctaaacctctccagcggctctgctgtttatcatcaaattatgagcaggctaccgcttggacctcagatg

SEQ ID NO: 1348 - protein, 622 aa, Vitis vinifera
  GSVIVT01014854001 polypeptide
MAGIDDHVAIIGDWVPPSPSPRMFFSMMLGDDVDSRATSEPTNENRNEAGDLGDQLTEFGAFSDQKLSSRGGLVERIAARAGFNAPRLNTESIRSADLSLNPDVRSPYLTIPPGLSPTTLLESPVFLSTSHAQPSPTTGKFPFIPNVNNRSSMLIPAAPDRSKEDLFEDFNTSSFAFKPVAESGSSFFNNGASKISAATIPQQSFPSIEVSVQSENSLPSQIMEPTKVHSQIGSAEHSPPLDEQQDEDGDQRGGVDNMVGGAPAEDGYNWRKYGQKQVKGSEFPRSYYKCTHPNCQVKKKVERSHEGHITEIIYKGAHNHSKPPPNRRSAIGSSNPLSDMQLDIPEQAGPHGGDGDPGQNGAPFESSDAVDASSTFSNDEDDDDRVTHGSVSLGYDGEGDESESKRRKVEAYATEMSGATRAIREPRVVVQTTSEVDILDDGYRWRKYGQKVVKGNPNPRSYYKCTNAGCTVRKHVERASHDLKSVITTYEGKHNHDVPAARNSSHVNSVHNMARFDRPPSFGTFNLPGRQQLGPSHGFSFGMNQPGLANLGMAGLGPTQGKLPALPVHPYLGQQRQVNEMGFMLPKGEPKVEPMSEPSLNLSSGSAVYHQIMSRLPLGPQM

SEQ ID NO: 1349 - DNA, 2217 bp, Solanum lycopersicum
  Solyc07g066220.2.1
atgggtggatttgatgatcatgttgccattatgggagattggatgcctccaagtccaagtccaagaacgtttttctcttcactgctaggcgatgatggtgggtcaagattatcgtttgatggcaccaatgaaactagtggaaacttagcttctggtcctcaagaacatgttggcaattcagatggagttgatacagcaccagctgcaatcagtgagccacaaccggtgaagttgagtgtgccgtctgaccagaaaatgaactctcgcggaggaggactcttggaaagaatagcagctagagcaggatttaatgccccaaagctgaacacggagagccttagacctgctgatctgaggcagaatcaaggagttcgctctccttatttaactattcctcctggtcttagtccaacaaccctgctagagtctcctgtttttctctccaattcactggtgcaaccatccccaacaactggaaaatttctattttcctcaggcattgacaatagaaactcggcattgatgatggaggatacagataaaaggaaagataatgctttagagagtatcaattcatcatccttttctttcaagccagttccagagactgctccatctctttttcctggcacgaccagcagatcttggttgcaggtgaacccgtccaatttttctcagcaaggatttccaaacattgaagtttcggttcattcccagaattcgcttgtatctcaccgtgtggaagctacacaaaacccgactcagaatggaacgcttcagcaatcatctgatttccctagattttctgctgagaaggatgtcatggctaataatgttaccctagattctaggacttttcagacagttggtagtgctgtggaccattctccacctctcgatgaaccgcaagatgaggacattgatcaaagaggaggtggagatccaaatgttgctggtgccccagctgaagatggttataattggcgaaaatatgggcagaaacaagttaaggggagcgagtacccccgaagttattacaagtgcacacatccaacctgtccagtcaagaagaaagtggagcgatctccagagggtcatattactgagattatatacaagggagcccacaatcacccaaaacccccacctaaccgtagatcagcccttggatccacaaattcacttggtgacctacaggtggacggtgcagaacaaggtgcaagtggtgttaatggtgatctcggtcaggcaaacttccacaaagcacctggtggtggaggaggttttgattggaggaacaacaatcgtgatgcaaacttgggctccgagcactgcaacagatctgcccctttctctgctcagaataacactcgtttggaatcaggtgatgcagtagatgtgtcgtcgaatttttcaaatgatgaagatgaagatgatcgtggaactcatggcagcgtatcacaaggttatgagggtgaaggagatgagtccgagtctaaaagaaggaagcttgagacctactctgcagatatgactggtgctactagagccatcagggagccaagagttgtggttcaaactacaagcgaagtggacatccttgatgatggatatcgctggcgcaagtatgggcaaaaggttgtcaaagggaatccaaatccaaggagttactacaagtgcacaagtgctggctgcaatgtcaggaagcatgttgagagggcctcgcatgacctgaagtcagtgattaccacctacgaagggaagcacaaccacgacgttcctgcagctcgcaacagtagtcatgttaattcaggtgcctccaacactcatccagcttcagttactgcccctgctcaaaaccatttacataggccggaggctgctcaacttcagaatgctatggcgcgatttgacaggcaaccttcattgggctcatttggtctgtcagggaggcccccccagcttggacctaacccaggatttagctatggaatgaaccagcaaggcggcctatccagtctagcaatggccggatttcatcctaatcaaaacaagccaggggaggttcctatgcatccatatctaggacagccgcgacccatgcatgatatgggatttatgttcccaaaggaagaaccaaaggtggaacctctgtcagatcctggcccaacagcttatcagcaatttttgaacagtttgtcgcttggacctcagatg

SEQ ID NO: 1350 - protein, 739 aa, Solanum lycopersicum
  Solyc07g066220.2.1 polypeptide
MGGFDDHVAIMGDWMPPSPSPRTFFSSLLGDDGGSRLSFDGTNETSGNLASGPQEHVGNSDGVDTAPAAISEPQPVKLSVPSDQKMNSRGGGLLERIAARAGFNAPKLNTESLRPADLRQNQGVRSPYLTIPPGLSPTTLLESPVFLSNSLVQPSPTTGKFLFSSGIDNRNSALMMEDTDKRKDNALESINSSSFSFKPVPETAPSLFPGTTSRSWLQVNPSNFSQQGFPNIEVSVHSQNSLVSHRVEATQNPTQNGTLQQSSDFPRFSAEKDVMANNVTLDSRTFQTVGSAVDHSPPLDEPQDEDIDQRGGGDPNVAGAPAEDGYNWRKYGQKQVKGSEYPRSYYKCTHPTCPVKKKVERSPEGHITEIIYKGAHNHPKPPPNRRSALGSTNSLGDLQVDGAEQGASGVNGDLGQANFHKAPGGGGGFDWRNNNRDANLGSEHCNRSAPFSAQNNTRLESGDAVDVSSNFSNDEDEDDRGTHGSVSQGYEGEGDESESKRRKLETYSADMTGATRAIREPRVVVQTTSEVDILDDGYRWRKYGQKVVKGNPNPRSYYKCTSAGCNVRKHVERASHDLKSVITTYEGKHNHDVPAARNSSHVNSGASNTHPASVTAPAQNHLHRPEAAQLQNAMARFDRQPSLGSFGLSGRPPQLGPNPGFSYGMNQQGGLSSLAMAGFHPNQNKPGEVPMHPYLGQPRPMHDMGFMFPKEEPKVEPLSDPGPTAYQQFLNSLSLGPQM

SEQ ID NO: 1351 - DNA, 1797 bp, Eucalyptus grandis
  Eucgr.B01415.1
acattttcactggttacctttcctgctgatagttcaatggtgcactcagaaagtaccaatgatggtgataagggattctccagtggccggactttcagcttcaagcctgatgggtgttcctcccctctctctggtttttctgctttacaagatcaggggatcggcattgataaacaaggcttccttctagaagatcctaaaatggatattgaattccaaacagaaatatatcaggaagctgctgaaaagaacggtgcctttaattcatcttctgatgcagaagtattgagtgaaatgaactcagatggtgcccaagagaaagaatctgttcctgaagaggatacgcggattgacaatgctgaggaaggagatcaaaaagggatgtacccctcagttgggacagttaggacttcagaagatggatataattggagaaagtatggccagaagcaagtaaaaggtagtgaatttccaagaagctactataagtgtacccagccaaattgtcaggttaaaaagaaggttgagcgttctcttgatggtcaaataacagaaataatctataagggtactcataatcatccaaaacctcagcctattcgatgtggactgcttagatcatcattttcactgaatgaaatgtcagagatggctgacggcagtggagctgctaataaagttgaaggtggatcagtttggagaaataatcagttagggtctaaagatgttaggctcggtccggattggagatctgatggtccagagcaaacatcctcaacatctgtcttaactgagctttctggtcttctgccaacctcacaaggaaaatgtgcagttgcttttgaatcagcacaaactccagaactctcttctacattggctagcactgatggtgacgatgaagatggggctacacaaggaagcatgtcacatggagaggatgctgacgatgaggaacctgagtcaaaacgaaggaaatcagagaactctttgagtgaatcgaatttgggatccagagctgtccgtgaaccgagggttgtcatccagatagagagcgacatagacatacttgatgatggttacaggtggagaaaatatggtcaaaaggtggtaaaaggaaatcccaaccctaggagctactacaagtgcactagtgctggttgctctgtgaggaagcatgtggaaagagcctctgacaaccttaaatatgtaatcacgacatacgagggaaaacacaaccatgaagttcctgcagccaggaatagcaatttaccctcaggtagtggaaatttgtctccagctgctgttggtgctcaagcaaacatggcaatacctagaaactctcgtactaataagccggaggcacaggttcaagaccttccactatttgatagaaagcctgagttacataatgagtttctgagatcgagtttactcaccaattttggcaacgacatgaaatttggcgcttcccctgtgttcccgttcaagttcccgcctcttcaaagtgccataccttgtggctcctttggcctgaatcccagccagggtgcaatgcatcaggccggtcctatagcctctttagttccagatcttcctatctctctaccttacaagtttcgcccgtacccaaaagttcctgtgactggtcttttcgatgataatcatattggaaagcctgctggttcacttcagtcagccctttcaggacagcggctaaaacagaacgatatgagattcctcactccaaagcaggagcaaagggatgatcatctgtacgatccttgccttccagtt

SEQ ID NO: 1352 - protein, 600 aa, Eucalyptus grandis
  Eucgr.B01415.1 polypeptide
TFSLVTFPADSSMVHSESTNDGDKGFSSGRTFSFKPDGCSSPLSGFSALQDQGIGIDKQGFLLEDPKMDIEFQTEIYQEAAEKNGAFNSSSDAEVLSEMNSDGAQEKESVPEEDTRIDNAEEGDQKGMYPSVGTVRTSEDGYNWRKYGQKQVKGSEFPRSYYKCTQPNCQVKKKVERSLDGQITEIIYKGTHNHPKPQPIRCGLLRSSFSLNEMSEMADGSGAANKVEGGSVWRNNQLGSKDVRLGPDWRSDGPEQTSSTSVLTELSGLLPTSQGKCAVAFESAQTPELSSTLASTDGDDEDGATQGSMSHGEDADDEEPESKRRKSENSLSESNLGSRAVREPRVVIQIESDIDILDDGYRWRKYGQKVVKGNPNPRSYYKCTSAGCSVRKHVERASDNLKYVITTYEGKHNHEVPAARNSNLPSGSGNLSPAAVGAQANMAIPRNSRTNKPEAQVQDLPLFDRKPELHNEFLRSSLLTNFGNDMKFGASPVFPFKFPPLQSAIPCGSFGLNPSQGAMHQAGPIASLVPDLPISLPYKFRPYPKVPVTGLFDDNHIGKPAGSLQSALSGQRLKQNDMRFLTPKQEQRDDHLYDPCLPVV

SEQ ID NO: 1353 - DNA, 1201 bp, Glycine max
  Glyma09g38580.1
aaatatggacaaaaacaggtaaaaggtagtgagtatcccagaagctattataaatgcacacagcctaaatgtcaggtcaagaaaaaggtggaacgatcccatgacggtcaaataacggaaattatttacaaaggtgctcataaccatgcacaaccacaccctggacatagagcatcttcactttctactgatgaggtttcagacatggctggagacagtaccttagctaaaattgaaggtgggtatgtttggagaaatattcaaacaggattaagagaaacaaaacaaagttttgattggaaggctgatggacaggaaaggacaccaacaacttctgctgtgactgagctttcagatcctatatcaactaacaatgctaaatctctatgtatgcttgaatcggaggacactccagagctttcttctacacttgccagtcatgatggcgatgaagatggaaccgctcaagcacttgtctcagctgaagacgaagctgagaatgatgaattggattcaaaaagaaggaagaaagagagctacgcagttgaaccaaatttgccccctactagggctgttcgtgagccaagagtggttgtccaaattgagagtgatgtggacatacttgatgatggttaccgctggcgtaagtatggacaaaaggttgtcaaaggaaatccaaatcctaggagctactacaaatgcacaagtgcgggatgtatggtaaggaagcatgtggaaagggcttcacagaatctgaaatatgtcctaactacttatgagggaaagcataatcatgaagtgcccactgctagaacaaacaatcaggtaaactcaagtgatggtggtttacctcccaatggtgctaatggacaagttgctcttacattaccaaagcccgaaactcatcaaactctttttggacatcattttgatagaaaacctgaattcagcaacgagtttctcagggctagtttggtcggaagtttcagcaatgatatgaagtttggaccttctaccctttgccaaatgaagtatccttccttgaataataccatgccttatggctcctacggactgaaccatgaacattgcactgcccctcaagctggatccattgcctcaatgttccccgattttccaatgccactaccattgaatcttccctcatctggacttaattttaactgtgtcaagccaatga

SEQ ID NO: 1354 - protein, 402 aa, Glycine max
  misc_feature (402)..(402): Xaa can be any naturally occurring amino acid
  Glyma09g38580.1 polypeptide
KYGQKQVKGSEYPRSYYKCTQPKCQVKKKVERSHDGQITEIIYKGAHNHAQPHPGHRASSLSTDEVSDMAGDSTLAKIEGGYVWRNIQTGLRETKQSFDWKADGQERTPTTSAVTELSDPISTNNAKSLCMLESEDTPELSSTLASHDGDEDGTAQALVSAEDEAENDELDSKRRKKESYAVEPNLPPTRAVREPRVVVQIESDVDILDDGYRWRKYGQKVVKGNPNPRSYYKCTSAGCMVRKHVERASQNLKYVLTTYEGKHNHEVPTARTNNQVNSSDGGLPPNGANGQVALTLPKPETHQTLFGHHFDRKPEFSNEFLRASLVGSFSNDMKFGPSTLCQMKYPSLNNTMPYGSYGLNHEHCTAPQAGSIASMFPDFPMPLPLNLPSSGLNFNCVKPMNX

SEQ ID NO: 1355 - DNA, 1617 bp, Glycine max
  Glyma18g47740.1
atttctgataaaaatttgatctttttttatgattggggttataggccatatctcccaccgttggctctttcttcacgctgccacttctcagccatgaaggatcaatgctcacaactgaacaagggaatgtggatgtgtcaaccgcatttgatgcatgtttctagtcatttccactcagtaaagggagaaaatagagagagccacctacttgctcaagttcagccaccattagatttttcatgccaagcagatttttcaaaaggccattctgtgaaaaatagtgaagtgaattcgtacaatgatatgaaaatggtaaatgatgcgattgttaatgccaataatgttgagatgccaatgtctggctctgaggaagtaagtgatgaaagcgctatgctgaaaaatgctatcaatggtgaggatttcggagggcaacctgcttcagaaggagaacagaaagaggtatcccatgcaacgggagcagttaaaggtagtgagtatcccagaagctattataaatgcacacagcctaattgtcaggtcaagaaaaaggtggaacgatcccatgacggtcaaataacggaaattatttacaagggtgctcataaccatgcacaaccacaccccggacatcgagcatcttcactttctactgatgaggtttcagacatggctgaagacagtaccttagctaaaattgaaggtgggtatgtctggagaaatattcaaacaggattaaaagatacaaaacaaagttttgattggaaggctgatggacaggaaaggacatcatcaacttctgctgtgactgagctttcagatcctatatcaactaacaaagctaaatctctacgtatatttgaattggaggacactccagagctttcttctacacttgccagtcatgatgatgatgaagatgggaccgctcacgcacttgtgtcggctgaagacgaagctgagaatgatgaattggaaccgaaaataaggaagaaagagagctatgcagttgaaccaaatttgccccctactagggctgttcgagagccaagagtggttgtccaaattgagagtgatgtggacatacttgatgatggttaccgctggcgtaagtatggacaaaaggttgtcaaaggaaatccaaatcctaggagctactacaaatgtacaagtactggatgtatggtaaggaaacatgtggaaagggcttcacacaatctgaaatatgtccttactacttatgagggaaagcataaccatgaagtgcccactgctagaaccaacaatcaggtaaactcaagtgatggtggtttacctcccaatggtgctaatggacaagtttctcttacattaccagggaatgctggcattccaaagcccgaaactcatcaaactcttggacatcattttgatagaaaaccggaattcagcgacgagtttctcaggcctagtttggttggaagtttcgggaatgatatgaagtttcggccttcttccctttgccaaatgaattctatgactgttgtttcaatttgttggttttgtggaggaaattataaaaaacagaggagagaagagacacaatacataaggaatcacttattgactaggctaatccat

SEQ ID NO: 1356 - protein, 539 aa, Glycine max
  Glyma18g47740.1 polypeptide
ISDKNLIFFYDWGYRPYLPPLALSSRCHFSAMKDQCSQLNKGMWMCQPHLMHVSSHFHSVKGENRESHLLAQVQPPLDFSCQADFSKGHSVKNSEVNSYNDMKMVNDAIVNANNVEMPMSGSEEVSDESAMLKNAINGEDFGGQPASEGEQKEVSHATGAVKGSEYPRSYYKCTQPNCQVKKKVERSHDGQITEIIYKGAHNHAQPHPGHRASSLSTDEVSDMAEDSTLAKIEGGYVWRNIQTGLKDTKQSFDWKADGQERTSSTSAVTELSDPISTNKAKSLRIFELEDTPELSSTLASHDDDEDGTAHALVSAEDEAENDELEPKIRKKESYAVEPNLPPTRAVREPRVVVQIESDVDILDDGYRWRKYGQKVVKGNPNPRSYYKCTSTGCMVRKHVERASHNLKYVLTTYEGKHNHEVPTARTNNQVNSSDGGLPPNGANGQVSLTLPGNAGIPKPETHQTLGHHFDRKPEFSDEFLRPSLVGSFGNDMKFRPSSLCQMNSMTVVSICWFCGGNYKKQRREETQYIRNHLLTRLIH

SEQ ID NO: 1357 - DNA, 1608 bp, Populus trichocarpa
  POPTR_0013s08380.1
atggacaacaacccagcagcggagtacaaaaccctactgtgggttcccaatcttgaaaccaaaagcagcaacggtggtgttggtggtgataataacagagggattagtattgcagagagaagagcagcgaagtgcgggttcaaaatgaaagcggagaggatcaatacagcccgctttcgaaccaccagccccttgacatctccgcttcgctctccctttataaccattccttctggcatcagccccactgccttgcttgattcgcccattatgctatccaattctcatgttcagccgtctcccaccactggaacttttccattatcccctctcaaatatgaaagtgaaagttttaatcccatttatgtacaaagagaaactatccatggagaaaatgttgcgtcatgtcgccttatggaagaaattaaacgaacattacctgcaacaacaattggaaggtcttcagaagatggatacaattggagaaagtatgggcagaaacaggttaaaggtagtgaatatcctagaagctattataagtgtaaccatgcaaattgtctggtaaagaaaaaaatagagtgtgcccatgagggccaaataacagaaatcatttacaaaggttcacataatcaccctaaacctcagccaaaaacatatgaatcaacaaaaactccggaactttcctccacacttgcaagtcatgatgatgatggggttactcagggaagctcgtttggtgctgatgctgatgatgagtctgagtcaaaaagaagggctgctatccgtgagccaagagttgttgttcaaattgagagtgaagtggacatactagatgatggttaccgctggaggaagtatgggcaaaaagttgtcaaggggaatccaaaccctaggagctactataaatgcacaagtgctggatgttcagttaggaagcatgtggagagagcctcccacgatctgaaatatgtaattataacttacgaagggaaacacaatcatgaagtgcctgcagccagaaacagcagtcacggaaactcaactggtagcaatttttcccagactactggcaatgcacagcttgccctggcattggccagaaacaccaatgcgccaaaccctgaagcacaaattcaagagtttgcacccagttttgatagaaaaccagtatttaacaatgactatttgagatccaatttgcctggaaatttcagtaatgaaatgaatcttgggtcttcctttgtttaccccatgaggtttcctcccatccaaaacgccatgccttatgattctttcgggttcagcaacaaccagcttgctgccagtcactctggatctgttgcctcgcttgttccagattttccaagatcattgtcgccatgtcttcaaacagctgcaaatctttctctggctagagttgattttagttgtgatgggaaaccagttggtcaagttcagactttcctccagggacagcagtcgatcaggcctaaacaagagcaaaaggatgataacatttatggtgctagctcgtccatcatggataatctaaatgcaccatcttcatcattgtcagtatatcatcagctcctgggaaactttcaatct

SEQ ID NO: 1358 - protein, 536 aa, Populus trichocarpa
  POPTR_0013s08380.1 polypeptide
MDNNPAAEYKTLLWVPNLETKSSNGGVGGDNNRGISIAERRAAKCGFKMKAERINTARFRTTSPLTSPLRSPFITIPSGISPTALLDSPIMLSNSHVQPSPTTGTFPLSPLKYESESFNPIYVQRETIHGENVASCRLMEEIKRTLPATTIGRSSEDGYNWRKYGQKQVKGSEYPRSYYKCNHANCLVKKKIECAHEGQITEIIYKGSHNHPKPQPKTYESTKTPELSSTLASHDDDGVTQGSSFGADADDESESKRRAAIREPRVVVQIESEVDILDDGYRWRKYGQKVVKGNPNPRSYYKCTSAGCSVRKHVERASHDLKYVIITYEGKHNHEVPAARNSSHGNSTGSNFSQTTGNAQLALALARNTNAPNPEAQIQEFAPSFDRKPVFNNDYLRSNLPGNFSNEMNLGSSFVYPMRFPPIQNAMPYDSFGFSNNQLAASHSGSVASLVPDFPRSLSPCLQTAANLSLARVDFSCDGKPVGQVQTFLQGQQSIRPKQEQKDDNIYGASSSIMDNLNAPSSSLSVYHQLLGNFQS

SEQ ID NO: 1359 - DNA, 1503 bp, Populus trichocarpa
  POPTR_0019s08110.1
atgggcatcaatcctggagcagcagcgtctgttaaaagggaaagcagaaatggtgatggtaatgccagaggcattgttagtactgtagagaggagagcagcaaaatgcgggttcaaaatgaagaaatcggagaggatcaatacggctcgctttcgaaccaccagccctttcaactctccttccgctactcctttttttttttttaatgtgggtgtccgggtcagcttgcgcgtacctcgactaatcccacgggtcctgaagttaacgaccatccctttgaactctccttccgcgactccttttataatcattcctcccggcgtcagcccaaccgccttgcttgatacgcccgttatgctacccaattctcatggtcagagaatgggtggttatggtgatggagataggggaagtagtaattcaagcggtctctccttcagattcaagccttatggttatggggatgctcttccaggcttttgtacttcaggaaatcagggtaatgattttgattttgaagctaatatcttgttggacccagcaatggattttcaatttccgatggggttttcagaggaagctgctctagagaaatgcaccagtggttcacgtactgatgtgaatgtcttagatagcatgattgcaaatgccacttgctcttctgattcacctagtaatcccatttatgtacaaagcgaaactatccatgaagaaaacattgagtcgcatcatcaccttttggaagaacagaaaggaacattaccggcaacagcaatcggaaggacttcagatgacggatacaattggagaaagtatgggaagaaactgattaaaggtagtaaacatccaagaagctattataagtgtaaccatgaaaattgtctggtcaagaaaaaaatagaatgtgcccatgatggtcaaataacaggaatcctttacaaaggtacacacaatcaccctcagcctcagccagttcatgatgggaaggttgatggcctggaaaggacatcctcaacctctgttgtgaccgagttttcagattcgttatcagccgctcaagtcaaatcattaggaacatctgaatcaacagaaactccagagctttcctccatacttgctagtcatgatgatggggttactcagggaagctcatttagtgttgatgttgatgatgagtccgagtcaaaaagaaggaagatagagagcagtttggttgaaacaaacatggcatcaaggcttgtccgcgaaccaagagttgttgttcaagtagagagtgaagtcgacatactagatgatgggtatcgctggaggaagtatgggcaaaaggtcgtcaaggggaatccaaacccaaggagctactataaatgcacaagtcctggatgttcagtaaggaagcatgtggagagaggcccccgcaatctaaaacatgtaattacaacttatgaagggaaacacgatcataaagtgcctgcggagaaacagcagtcgcggatactcagctgg

SEQ ID NO: 1360 - protein, 501 aa, Populus trichocarpa
  POPTR_0019s08110.1 polypeptide
MGINPGAAASVKRESRNGDGNARGIVSTVERRAAKCGFKMKKSERINTARFRTTSPFNSPSATPFFFFNVGVRVSLRVPRLIPRVLKLTTIPLNSPSATPFIIIPPGVSPTALLDTPVMLPNSHGQRMGGYGDGDRGSSNSSGLSFRFKPYGYGDALPGFCTSGNQGNDFDFEANILLDPAMDFQFPMGFSEEAALEKCTSGSRTDVNVLDSMIANATCSSDSPSNPIYVQSETIHEENIESHHHLLEEQKGTLPATAIGRTSDDGYNWRKYGKKLIKGSKHPRSYYKCNHENCLVKKKIECAHDGQITGILYKGTHNHPQPQPVHDGKVDGLERTSSTSVVTEFSDSLSAAQVKSLGTSESTETPELSSILASHDDGVTQGSSFSVDVDDESESKRRKIESSLVETNMASRLVREPRVVVQVESEVDILDDGYRWRKYGQKVVKGNPNPRSYYKCTSPGCSVRKHVERGPRNLKHVITTYEGKHDHKVPAEKQQSRILSW

SEQ ID NO: 1361 - DNA, 1458 bp, Vitis vinifera
  GSVIVT01019109001
atgtgtggcatttatggtttgattaggtttcttccccttccgatcttgctcaaagttttggggctgaagttcactatcaaacttgtgctccaacacattcaccagtgggtttcgaatttgccacagaattctctacagaagcttctgctaaaaactatgtggatgcatcacattccagaagaacagaaaggcacatacccttccatgggaatgggaagaacttcagaagatggatacaattggagaaaatatgggcaaaaaagtatgaaaggtagtgaacatacaaggagctattataaatgtactcatctagattgtccaatgagaaaaaaggtacaacaatcacatgatggtcaaataacagaaattatctataagggtggtcataaccacccaaaaccactgcctagtcgtcgatcagctcttggatccacacttccatttaatgagatgtcaggtttgggggaaggtggtggatctagtgtcagagttgaaggaaccccagatctttccttaacagttgctagtcaagatgatggtgaagatggggctactcaaggaagcatatcacttggagatgatgctgatgatgaaggttctcagtcaaaaaaaaggaagaaagagaattgtatgactgaaaaaaatttggcatccaggactgtacgtgaaccaagggttgttgtccaagtagagtgtgaatcggacgtccttaatgatggatatcgctggcgaaagtatggacaaaaagtcgtcaaaggcaatctgcatcctaggaattactacaagtgcacaagcactggatgctcagtgaggaggcatgtggaaagagcttccaacaatcagaaatccataattgcgacatatgaaggaaaacacaatcatgaagtgcctgcagccagaaacagcagtcatgtgaattcaagtggtggaaatttgccttcagctgctcctggtgctcaatcagcactggctttgcacaggaatgctaatgccccaaggccagaagcactacttcaagatcttgtcccccactttgacataaaacctgaattcagcaatcagtatataaggcacagtatgcttgggaactttgctaatgatatgaaatttggtccttcctccctttattcaatgcagttccctcccctgcaaaataccatgctttatgctccttttggactggattctaataatgctgatccccaccaacctggttcagttgctccagtagccccagatttcccaatttcattgccattgaatctccccccacctgcaaatctgggtctgcctggctttgacttcaacagtcatggaaacccgattggtcaagttgagccatatttcgtggggcagcagcttcaggagaacgatatgaggttcctccatcctaaagaggagaagaaggatgacattggtgatgcaactacatcatgttcatcatcaacaatatatcac

SEQ ID NO: 1362 - protein, 486 aa, Vitis vinifera
  GSVIVT01019109001 polypeptide
MCGIYGLIRFLPLPILLKVLGLKFTIKLVLQHIHQWVSNLPQNSLQKLLLKTMWMHHIPEEQKGTYPSMGMGRTSEDGYNWRKYGQKSMKGSEHTRSYYKCTHLDCPMRKKVQQSHDGQITEIIYKGGHNHPKPLPSRRSALGSTLPFNEMSGLGEGGGSSVRVEGTPDLSLTVASQDDGEDGATQGSISLGDDADDEGSQSKKRKKENCMTEKNLASRTVREPRVVVQVECESDVLNDGYRWRKYGQKVVKGNLHPRNYYKCTSTGCSVRRHVERASNNQKSIIATYEGKHNHEVPAARNSSHVNSSGGNLPSAAPGAQSALALHRNANAPRPEALLQDLVPHFDIKPEFSNQYIRHSMLGNFANDMKFGPSSLYSMQFPPLQNTMLYAPFGLDSNNADPHQPGSVAPVAPDFPISLPLNLPPPANLGLPGFDFNSHGNPIGQVEPYFVGQQLQENDMRFLHPKEEKKDDIGDATTSCSSSTIYH

SEQ ID NO: 1363 - DNA, 2109 bp, Solanum lycopersicum
  Solyc10g005680.1.1
atgtccgggttcaatgatcttgttcctaatggagattggctaccaactagcccgagccccagcccgagctcaagagcactcatctcttcactgagagctgatgattttggatggccagctcatctggaggaagctaatgaaagtacatgcaaaaacctcgtggtcgagcctcaagagcatgtcaactggagcaactctgttggaaatgatggggcacaaactggtgcaatgactaatcaaacagtgaatgtgagtgcaccatcaaagcagaacacgagttctcgtggagggctcatggaaagaatggcagctagaactggatttaacgtctcgaggctgaacacagatggacttagaccttcttttgtgtcacagaatcaagagattaagtctccttatttgagtattgctgctggtctcagtccatcaatcctcttatattcacctgttatgctctataattcactgaccattttgccacaggtatctcctccaactggactattaccatgtgcctctggcaacgagggtagaagcgttatgttgatgactgaagctgcagataagatgaatgagactgcttttgggactaatagttcatcttacttgtctttcaatccaattatggagactggcggagtaaacgagtttcaaattgagggttcagttgatccaaataactctctccaacttcacagtatggaagcaactcaaaatgaacagatatgtaatgaaacaactgatatccctatgtttactgaagaggatgtccggggtagtgataagaatccagaggtaagggcctttaatgcagttggtggtattacggagcatcctccgtctcttgaaaagcaacaaaatgagggtgctgctggtgatacttcagttgaagatggtcataattggattaaatatggggaaaatcaagttaaaggaagcgagtatcctcggagtttttataagtgcacacatccaaattgtcttgtcaagaaggaaatagcgcgatatcatcaaggtcatgtcacggaagttatatacaatggggctcacaaacacccaaaaccacagccaaatcagatatcaggccccggatcttcaagttcatttggtgacctccaactagacaatgtggatccaactggaacaggtgttaacagtgatctggctttggaaaccgtccaacaaggacctactgctggaggcctcaagcggaagaacgacaatcttgaagcaatatcattcgcagctttgcactctgaatactgcaggggagctgctactttacattcaaatgatgctcagctgggatcagccgatacagttgacatagcatctattttttcaactgaaggagatgatcatggtacttgtggaagtgcacctctagattgtgacgatggaggatatgaccccgagtctaaaataaggaagatagaagcggatgcaacagatacgagcagcgtcagcagatcaatgaagcagccaagaattgtggtagaaactatcagtgaggtagacgtcattgaagatggatatcgctggcgcaagtatggccaaaagttggttaaaggcaatccaaatcctaggagttactacaagtgcacaaactccggctgcagtgtcaggaaacatgtcgagaggtctccattagatcagatgtccgttattaccagttatgatgggaagcacaaccatgacgctccagaagaacgcagcagtatccaagttagctcaattgcttcaatctatcgctccaatccgataattactaatgctcaagaccaggtaggtaggcctgaacctaaacaacttcagaagaacagcaggcgttacggaaggggtcccccgtttggttctacctcaggctttaacagttccgaaactaaccagcagcaaggtctaaccggtccttctatgaccggattcaactctgagcagcaccagttttcagtccctgcctatccatatccaggatggccacaacctgttaacgatgctggtttcgtgcttccagaaggaaaaccaatgccaaatcctaacatgaactactccaatgcctcatcaacttatcagcaaactatgaatggattgcctcctggacctcagatg

SEQ ID NO: 1364 - protein, 703 aa, Solanum lycopersicum
  Solyc10g005680.1.1 polypeptide
MSGFNDLVPNGDWLPTSPSPSPSSRALISSLRADDFGWPAHLEEANESTCKNLVVEPQEHVNWSNSVGNDGAQTGAMTNQTVNVSAPSKQNTSSRGGLMERMAARTGFNVSRLNTDGLRPSFVSQNQEIKSPYLSIAAGLSPSILLYSPVMLYNSLTILPQVSPPTGLLPCASGNEGRSVMLMTEAADKMNETAFGTNSSSYLSFNPIMETGGVNEFQIEGSVDPNNSLQLHSMEATQNEQICNETTDIPMFTEEDVRGSDKNPEVRAFNAVGGITEHPPSLEKQQNEGAAGDTSVEDGHNWIKYGENQVKGSEYPRSFYKCTHPNCLVKKEIARYHQGHVTEVIYNGAHKHPKPQPNQISGPGSSSSFGDLQLDNVDPTGTGVNSDLALETVQQGPTAGGLKRKNDNLEAISFAALHSEYCRGAATLHSNDAQLGSADTVDIASIFSTEGDDHGTCGSAPLDCDDGGYDPESKIRKIEADATDTSSVSRSMKQPRIVVETISEVDVIEDGYRWRKYGQKLVKGNPNPRSYYKCTNSGCSVRKHVERSPLDQMSVITSYDGKHNHDAPEERSSIQVSSIASIYRSNPIITNAQDQVGRPEPKQLQKNSRRYGRGPPFGSTSGFNSSETNQQQGLTGPSMTGFNSEQHQFSVPAYPYPGWPQPVNDAGFVLPEGKPMPNPNMNYSNASSTYQQTMNGLPPGPQM

SEQ ID NO: 1365 - DNA, 2667 bp, Vitis vinifera
  GSVIVT01011472001
atggctgcaatctctccaatctccgtttctcccatccccaaaaccctaatccctacccgaacccaaaaacttcctcccacgacatctttccgctacccaaaaccctattccttatccatttcctcaattaggagccccaagacccgagcagccgacttctcttcattctccgccattgtgggacaagacctgcacagtgacgcagatgaatcgattggccttgacactctcaaacgtttcattgatatcaatttgggttgctggaacggctctttctaccaatttgattctctggggaatttgacccaaaaagtgagtacgaagcttgcagtgggctcttatggagaagatgaactcattagtctcattcaaacgttatacataaaacaacccccatcaagcacttcatgttctggtgatgatgatgagccagcgtgggcagagtacaaaatcaaagaaatcaatttgtttactgtggacaagtatcaacagattggctttttttccaatgagagggcatttgctttaagataccagacagcaggcatgttagagactgtgttaaggcaaggggttcttggtgaggatgacagtggagaagaatcacccaaaaatctgaagcttccgtctcgccgaccttctattgtatgtgagaattgcctttattcacaggagagtgatctgcgggctagagcattccacatcatggacccaaaaggcattttagacatgcttggtattttccttgaagaaagaggcaatggaaaatcttttcctccttccattgacatttctaaggacaaaacaaacaggattacaccatttcttggtaaatggaaaggtcgttctgtgacaaagcgcagtggtgtttatggatcaacaattgctgaagctaatacagtttccttacttgaaattaatgacaatgatcagcttgtccaggatatttcttcaacatccacatctggaggaggagatgtcaccactaatgtacattggaccggtgccttgtcaggcaacttggctacgtttgaagggggtttccagatgaccttactgcctggtggcatgtacatgggatatccatctgatatcgcaaagagcgtggcagaatccaagtcattccacctggagttctgttggcttgaatcacctgggaaaaggcagagactggttcgcacttatgacatggaaggcttggctgtctcctcaacccatttttctgagaccagagtgtggaggtgcatgaacccacatttaagaacgtggatccctacaaaggccaaaatgaaaacaaaaagagagggtgaacttggtaatgggagcggcgccaccaaggggacacccgtgagtaaaaaaactaaaaagtctgctgtgctccgtcgactttccacaaaatccataagagagaagggagttttggaggggtggaaattaaaccctaactatggtgaactgacggagctctctatggctcagaatgatacgtcctcgttttcatccaaagtggtggcgccctcccgccccaccattgctcttccccctcgctcctccatggacgctttcttcttcgccgccaccagtcccggccctatgaccctcgtctccagcttcttctccgacaattaccccgactccgactgccgctccttctctcagctcctcgccggcgccatggcttccccaggcgccaggcccactttgctctccgggttcaggcagaaccgccccttgagtttggcggttgctcggtcgccgatgttttccattccgcctgggttgagcccttcaggactgctcaattcgccgggcttcttttctcccctccagagcccgtttgggatgtcccatcagcaagccttggcacaagttacagcccaggctgcattatcccagtctcatatgttcattcaagcagagtatcaaccttcttcattggaagctcctcaggtgccaccactaccatcagaccctaagagttccatgacggagtcatcagaagtctctcattctgacaggaaatcccaacctccctctcttgttgttgataagccgggtgatgatggctacaactggcggaaatatggacagaagcagggcagcacaaccatgaatttaaacaggccaaatgaaactgtaaatgggtccagtgacagtgaggaagtgggtgatgctgaaactagagtaaaagaggatgatgatgatgatgaaccaaatcccaagagaaggcaagttgcagcacctgctgaggtagtatcatcacacaagacagtcactgaaccaaggatcattgtgcagacaagaagtgaagttgatcttttggatgatggctacaggtggcgcaagtatgggcaaaaagtggtcaaagggaatcctcatccaaggagctattacaaatgcactagcctgggctgtaatgtacgtaaacatgttgagagggcttcaacagatcctaaagctgtgataacaacatatgaggggaaacacaatcatgatgtcccagcagctagaaacagcagccacaacactgccaacagtaatgcaacacagctaaaacagcataatgtggtggctgagaagcgtgccttactcaaagagatgggtttcagaaacaaggataaaaaacctgttgcacttttacaactgaaagaagagcagattgcggtg

SEQ ID NO: 1366 - protein, 889 aa, Vitis vinifera
  GSVIVT01011472001 polypeptide
MAAISPISVSPIPKTLIPTRTQKLPPTTSFRYPKPYSLSISSIRSPKTRAADFSSFSAIVGQDLHSDADESIGLDTLKRFIDINLGCWNGSFYQFDSLGNLTQKVSTKLAVGSYGEDELISLIQTLYIKQPPSSTSCSGDDDEPAWAEYKIKEINLFTVDKYQQIGFFSNERAFALRYQTAGMLETVLRQGVLGEDDSGEESPKNLKLPSRRPSIVCENCLYSQESDLRARAFHIMDPKGILDMLGIFLEERGNGKSFPPSIDISKDKTNRITPFLGKWKGRSVTKRSGVYGSTIAEANTVSLLEINDNDQLVQDISSTSTSGGGDVTTNVHWTGALSGNLATFEGGFQMTLLPGGMYMGYPSDIAKSVAESKSFHLEFCWLESPGKRQRLVRTYDMEGLAVSSTHFSETRVWRCMNPHLRTWIPTKAKMKTKREGELGNGSGATKGTPVSKKTKKSAVLRRLSTKSIREKGVLEGWKLNPNYGELTELSMAQNDTSSFSSKVVAPSRPTIALPPRSSMDAFFFAATSPGPMTLVSSFFSDNYPDSDCRSFSQLLAGAMASPGARPTLLSGFRQNRPLSLAVARSPMFSIPPGLSPSGLLNSPGFFSPLQSPFGMSHQQALAQVTAQAALSQSHMFIQAEYQPSSLEAPQVPPLPSDPKSSMTESSEVSHSDRKSQPPSLVVDKPGDDGYNWRKYGQKQGSTTMNLNRPNETVNGSSDSEEVGDAETRVKEDDDDDEPNPKRRQVAAPAEVVSSHKTVTEPRIIVQTRSEVDLLDDGYRWRKYGQKVVKGNPHPRSYYKCTSLGCNVRKHVERASTDPKAVITTYEGKHNHDVPAARNSSHNTANSNATQLKQHNVVAEKRALLKEMGFRNKDKKPVALLQLKEEQIAV

SEQ ID NO: 1367 - protein, 7 aa, Arabidopsis thaliana
  conserved WRKY heptapeptide motif
WRKYGQK

SEQ ID NO: 1368 - DNA, 855 bp, Arabidopsis thaliana
  AtNAC6 (AT5G39610.1 or G525)
atggattacgaggcatcaagaatcgtcgaaatggtagaagatgaagaacatatagatctaccaccaggattcagatttcaccctactgatgaagaactcataactcactacctcaaaccaaaggttttcaacactttcttctctgctactgccattggtgaagttgatctcaacaagattgagccttgggacttaccatggaaggctaagatgggagaaaaagaatggtatttcttctgtgtgagagaccggaaatacccgaccggtttaaggacaaaccgggcgacagaagccggttattggaaagccacaggaaaagacaaagagatattcaagggaaaatcacttgtgggtatgaagaaaactttggttttctataaaggaagagctcctaaaggagttaaaaccaattgggttatgcatgaatatcgtttagaaggcaaatattgtattgaaaatcttccccaaacagctaagaacgaatgggttatatgtcgtgttttccaaaaacgtgccgatggtacaaaggttccaatgtcaatgcttgatccacacattaaccgaatggaaccagccggtttaccttcgttaatggattgttctcaacgagactccttcaccggttcgtcgtctcacgtgacctgcttctccgaccaagaaaccgaagacaaaagacttgtccacgagtccaaagacggttttggttctctgttttactcggatcctctgtttttacaagacaattattcgctaatgaagctgttgcttgacggtcaagaaactcaattctccggcaaacctttcgacggtcgtgattcgtccggtacagaagaattggattgcgtttggaatttc

SEQ ID NO: 1369 - protein, 285 aa, Arabidopsis thaliana
  AtNAC6 (AT5G39610.1 or G525)
MDYEASRIVEMVEDEEHIDLPPGFRFHPTDEELITHYLKPKVFNTFFSATAIGEVDLNKIEPWDLPWKAKMGEKEWYFFCVRDRKYPTGLRTNRATEAGYWKATGKDKEIFKGKSLVGMKKTLVFYKGRAPKGVKTNWVMHEYRLEGKYCIENLPQTAKNEWVICRVFQKRADGTKVPMSMLDPHINRMEPAGLPSLMDCSQRDSFTGSSSHVTCFSDQETEDKRLVHESKDGFGSLFYSDPLFLQDNYSLMKLLLDGQETQFSGKPFDGRDSSGTEELDCVWNF

SEQ ID NO: 1370 - DNA, 987 bp, Arabidopsis thaliana
  AT5G07680.1
atggaaactttcggtgtgtttcacaaggaagatgatgagcagatggatttgcctcctggttttaggtttcatccaacagacgaagaactcataacccactatctccacaagaaggttcttgaccttggtttctcggctaaagctattggtgaggttgatttgaacaaagctgagccatgggagttgccatataaagcaaaaattggtgagaaagaatggtactttttctgtgtgagggatagaaagtatccgactggtctgaggactaaccgagcaactcaagccggttattggaaggcgacagggaaggataaagagatcttccgaggcaaatcgcttgttggtatgaagaaaacacttgttttctacagaggaagagctcctaaaggccagaaaacaaattgggtgatgcatgagtataggctagatggaaaactctctgctcacaacttgcctaaaaccgctaagaatgaatgggtgatctgcagggtatttcataaaactgctggaggtaagaagatcccgatttcgacgttaatccgaatcggttcttacggaaccgggtctagtttaccacctttaactgattcttcaccatacaacgacaaaaccaagaccgaaccagtttacgtgccctgcttctccaaccaagctgaaactagaggaacaatactcaattgcttcagcaacccttcccttagctccatccaaccagattttctccagatgattccactctaccaacctcaatctctcaacatttccgagagttccaatccggttcttacgcaagaacaatcagttttacaagcgatgatggaaaacaacagaaggcagaacttcaaaacattgagcatctcgcaagaaaccggggtttcgaacaccgataactcatcggtttttgaatttgggaggaagcgatttgatcatcaagaagttccatctccctcttccggtccggttgatcttgaacctttctggaattac

SEQ ID NO: 1371 - protein, 329 aa, Arabidopsis thaliana
  AT5G07680.1
METFGVFHKEDDEQMDLPPGFRFHPTDEELITHYLHKKVLDLGFSAKAIGEVDLNKAEPWELPYKAKIGEKEWYFFCVRDRKYPTGLRTNRATQAGYWKATGKDKEIFRGKSLVGMKKTLVFYRGRAPKGQKTNWVMHEYRLDGKLSAHNLPKTAKNEWVICRVFHKTAGGKKIPISTLIRIGSYGTGSSLPPLTDSSPYNDKTKTEPVYVPCFSNQAETRGTILNCFSNPSLSSIQPDFLQMIPLYQPQSLNISESSNPVLTQEQSVLQAMMENNRRQNFKTLSISQETGVSNTDNSSVFEFGRKRFDHQEVPSPSSGPVDLEPFWNY

SEQ ID NO: 1372 - DNA, 954 bp, Arabidopsis thaliana
  AT3G29035.1
atggattacaaggtatcaagaagtggggagatagtagaaggagaagtagaagattcagaaaagattgatttaccacctggtttcagatttcacccaactgatgaagaacttataacacactatctaagaccaaaggttgtaaactcttttttctctgctatagctattggtgaagttgatctcaacaaagtcgagccttgggacttgccttggaaggctaagcttggggaaaaagagtggtacttcttttgcgtaagagaccgaaaatacccgactggtttaagaacgaatcgtgctactaaagccggttattggaaagctacagggaaagataaagagatcttcaaagggaaatctcttgttggtatgaagaaaacattggttttctacaaaggaagagctcctaaaggagtaaaaacaaattgggtcatgcatgagtatcgattagaaggcaaattcgctatcgataatctctctaaaaccgctaagaacgaatgtgttattagtcgtgtttttcatacacggactgatggtacgaaggagcatatgtccgttggtttacctccgctgatggattcttctccatatctaaagagtagaggacaagactctttagccgggaccacccttggtgggttgttgtctcacgttacctacttctccgaccaaacaaccgatgacaagagtcttgtggccgattttaaaactaccatgtttggttccggatcgactaactttttaccaaacataggttctctactagacttcgatcctctgtttctacaaaacaattcttcagtactgaagatgttgcttgacaatgaagaaacccaatttaagaagaatcttcacaattcaggttcatcagagagtgaactaacagcgagttcttggcaaggtcacaattcttatggttccactggtccagtgaatcttgattgcgtttggaaattc

SEQ ID NO: 1373 - protein, 318 aa, Arabidopsis thaliana
  AT3G29035.1
MDYKVSRSGEIVEGEVEDSEKIDLPPGFRFHPTDEELITHYLRPKVVNSFFSAIAIGEVDLNKVEPWDLPWKAKLGEKEWYFFCVRDRKYPTGLRTNRATKAGYWKATGKDKEIFKGKSLVGMKKTLVFYKGRAPKGVKTNWVMHEYRLEGKFAIDNLSKTAKNECVISRVFHTRTDGTKEHMSVGLPPLMDSSPYLKSRGQDSLAGTTLGGLLSHVTYFSDQTTDDKSLVADFKTTMFGSGSTNFLPNIGSLLDFDPLFLQNNSSVLKMLLDNEETQFKKNLHNSGSSESELTASSWQGHNSYGSTGPVNLDCVWKF

SEQ ID NO: 1374 - DNA, 1008 bp, Arabidopsis thaliana
  AT5G61430.1
atggagactttttgtgggtttcaaaaggaggaagagcagatggatttacctcctgggttcaggtttcatccaacagatgaagaactcataactcactatctccataagaaggttcttgacaccagcttctcagctaaagctatcggtgaagttgatttaaacaaatcagagccatgggagttaccatggatggcaaaaatgggtgagaaagaatggtattttttctgtgtgagagacagaaagtatcccaccggtttaagaactaaccgagcaactgaagccggttattggaaggcgaccgggaaggataaagagatataccgaggcaaatcacttgttgggatgaagaagacacttgttttctatagaggaagagctcctaaaggtcagaaaaccaactgggtgatgcatgagtacaggcttgaaggaaaattctctgcccataacttgccgaaaaccgcaaagaatgaatgggtgatatgcagggtgttccaaaagagtgctggagggaagaagatcccgatttcgagtctaatccgaatcggttcactcggaaccgactttaacccttcgcttttgccctctttaaccgattcttcgccttacaacgataaaaccaaaacagaaccggtctacgtgccctgcttctccaaccaaacggatcaaaaccaaggaaccacactcaattgcttcagcagccctgttcttaactcgatccaagccgacatttttcacaggattccactctatcaaactcagtccctccaggtttctatgaatctacagagcccggttctcacgcaagaacactcagttctacatgctatgatcgagaacaacagaagacaaagtctcaaaacgatgagtgtctcacaagaaaccggagtttcaactgacatgaacactgatatctcatcggattttgaatttggtaagagacggtttgattctcaagaagatccgtcttcctctactggaccggttgatcttgaacctttctggaattac

SEQ ID NO: 1375 - protein, 336 aa, Arabidopsis thaliana
  AT5G61430.1
METFCGFQKEEEQMDLPPGFRFHPTDEELITHYLHKKVLDTSFSAKAIGEVDLNKSEPWELPWMAKMGEKEWYFFCVRDRKYPTGLRTNRATEAGYWKATGKDKEIYRGKSLVGMKKTLVFYRGRAPKGQKTNWVMHEYRLEGKFSAHNLPKTAKNEWVICRVFQKSAGGKKIPISSLIRIGSLGTDFNPSLLPSLTDSSPYNDKTKTEPVYVPCFSNQTDQNQGTTLNCFSSPVLNSIQADIFHRIPLYQTQSLQVSMNLQSPVLTQEHSVLHAMIENNRRQSLKTMSVSQETGVSTDMNTDISSDFEFGKRRFDSQEDPSSSTGPVDLEPFWNY

SEQ ID NO: 1376 - DNA, 1026 bp, Glycine max
  Glyma04g33270.1
atggatttgcctcctgggtttaggtttcacccaactgatgaagagctaattagtcattacctttacagaaaggtcacccacaccaacttctcagctagggccattggagaggtggacttgaacaggtctgagccttgggatttgccatggaaagctaaaatgggagagaaagagtggtactttttctgtgtgagagacagaaaatacccaactggtttgaggactaatagagccactcaatcaggatactggaaggccacagggaaagacaaagagattttcagaggaaaatcccttgtgggtatgaagaaaactttggttttctacaaaggaagggctcccaagggagagaaaactgattgggtcatgcatgagtatagacttgatggaaaattctctgttcacaacctccccaaaactgcgaagaatgagtgggtgatttgcagggtttttcagaagagttcaggtgtgaagaggactcatatttctgggatgatgatgttggactcttatggaaacgaattgggttattcttcttctgctttgccacctctcactgattcctcaccttccattgacaacaccaaagtactgagtgttactgatacggcttacgtaccctgcttctccaatccaattgatgctccaagagggatcttcgattccttgaacaacattaacatcaccaccaccaccactaccaacaacaacaacaccctttatggagtttcttcaaaccattcattttacaatactcaacttcatattccaccaactttgccattacctagttcttcaaaccattaccttagagcctttcttgaaaaccaaggaaatggatcaaacatgaggaataatggttatgaaacagagagggaaatggtcagtgtctcacaggaaacaactatttctactgatgtgaacgctgaaatctcttcattgggtaaaaggcaatttgagaatcagcagaatccaactgcttcatcagctgttgttccaatggacgttgctaccttgtggaactac

SEQ ID NO: 1377 - protein, 342 aa, Glycine max
  Glyma04g33270.1
MDLPPGFRFHPTDEELISHYLYRKVTHTNFSARAIGEVDLNRSEPWDLPWKAKMGEKEWYFFCVRDRKYPTGLRTNRATQSGYWKATGKDKEIFRGKSLVGMKKTLVFYKGRAPKGEKTDWVMHEYRLDGKFSVHNLPKTAKNEWVICRVFQKSSGVKRTHISGMMMLDSYGNELGYSSSALPPLTDSSPSIDNTKVLSVTDTAYVPCFSNPIDAPRGIFDSLNNINITTTTTTNNNNTLYGVSSNHSFYNTQLHIPPTLPLPSSSNHYLRAFLENQGNGSNMRNNGYETEREMVSVSQETTISTDVNAEISSLGKRQFENQQNPTASSAVVPMDVATLWNY

SEQ ID NO: 1378 - DNA, 1071 bp, Glycine max
  Glyma06g21020.1
atggaaaacgtttcggttcttttgtgtaataaggaaaaggatcagatggatttgcctcctgggtttaggtttcacccaacagatgaagagcttattagtcattacctttacagaaaggtcactgacaccaacttctcagctagagccattggagaggtggacttgaacaggtctgagccttgggatttgccatggaaggccaaaatgggagagaaagagtggtactttttctgtgtgagggacagaaaatacccaactggtttgaggactaatagagccactgaatcaggatactggaaggctacagggaaagacaaagagattttcagagggaaatctcttgtgggtatgaagaaaactttggttttctacaaaggaagggctcccaagggagagaaaactgattgggtcatgcatgagtataggcttgatggtaaattctctgttcacaacctccccaaaactgcaaagaatgagtgggtgatttgcagggtttttcagaagagttcaggtgtgaaaaggactcatatttctgggatgatgatgttggactcttatggaaacgaaatggtttattcttcttctgctttgccacctctcactgattcctcaccttccattggcaacaacaccaaagcactgagtgtgactgattctgcttacgtgccctgcttctccaatccaattgatgttcctagaggaatctttgattccttgaacaacatcaatatcagcatcaacagcaacaccctttatggagtttcttcaaaccattcattttacaatactcagggggttcaacttcaggctccaccaactttgccattacctagttcttcaaaccattaccttagagcctttcttgaaaaccaaggaaatggatcgaacatgagcaacaatggttttgagccagagagggaaatggtcagtgtctcacagaaaacaagtctttctactgatgtgaaggctgaaatctcttcattgggtaaaaggcactttgagaatcaaaacaacccaattgcttcagcagctgcagttgcaccaatggaccttgctaccttgtggaactac

SEQ ID NO: 1379 - protein, 357 aa, Glycine max
  Glyma06g21020.1
MENVSVLLCNKEKDQMDLPPGFRFHPTDEELISHYLYRKVTDTNFSARAIGEVDLNRSEPWDLPWKAKMGEKEWYFFCVRDRKYPTGLRTNRATESGYWKATGKDKEIFRGKSLVGMKKTLVFYKGRAPKGEKTDWVMHEYRLDGKFSVHNLPKTAKNEWVICRVFQKSSGVKRTHISGMMMLDSYGNEMVYSSSALPPLTDSSPSIGNNTKALSVTDSAYVPCFSNPIDVPRGIFDSLNNINISINSNTLYGVSSNHSFYNTQGVQLQAPPTLPLPSSSNHYLRAFLENQGNGSNMSNNGFEPEREMVSVSQKTSLSTDVKAEISSLGKRHFENQNNPIASAAAVAPMDLATLWNY

SEQ ID NO: 1380 - DNA, 1050 bp, Glycine max
  Glyma17g10970.1
atggaaaacgttccggtggtgtgtaaggaagatgatcagatggatttgcctcccggatttcggttccacccgactgatgaagagcttataagccattacctctacaagaaggtcattgacaccaagttctgcgccagggctattggagaagtggacctcaacaagtctgagccttgggatttgccatggaaagccaaaatgggagaaaaggagtggtactttttctgtgtgagagacagaaaataccccactggcttgagaaccaacagggccaccgaagctgggtactggaaggccacaggaaaagacaaagagattttcagaggaaaatctttggttggaatgaagaaaactcttgttttctacagaggtcgagcacctaaaggtgaaaaaagcaattgggtcatgcacgagtacagactcgaggggaaattctctgttcacaacctcccaaaaactgcaaagaacgagtgggtgatttgcagggtgtttcagaagagttcagctgggaagaaaactcatatctcggggataatgaggttggactcttttgctgatgaattgggttcttctgctctgccacctctctcggattcttcgccttctatcggtaacactaaacctcttaatgatacggcttacgtgccctgcttctccaatccaattgatgttcaaagaaaccaagaaggtgtctttgattccttcaccaactctatctatgcggtttcttcaaatcctatgggcattcttcccagaatgccaccttctggctccttctactccactcaaggtgttcaagctgcgcctaatttggcatttcctggttctgtttacacccttcaggatcacaccatcctgagaaccttatgtgaaaacaatggttacaagccagagagggacatgatcagtgtttcgcaggaaacgggtctaactactgatatcaacgctgaaacctcttcaaattttgatatgggtaggaggccctttgagaatcacaatcatgcatctgtttctgttgccccattggatcttgatggtttgtggaattac

SEQ ID NO: 1381 - protein, 350 aa, Glycine max
  Glyma17g10970.1
MENVPVVCKEDDQMDLPPGFRFHPTDEELISHYLYKKVIDTKFCARAIGEVDLNKSEPWDLPWKAKMGEKEWYFFCVRDRKYPTGLRTNRATEAGYWKATGKDKEIFRGKSLVGMKKTLVFYRGRAPKGEKSNWVMHEYRLEGKFSVHNLPKTAKNEWVICRVFQKSSAGKKTHISGIMRLDSFADELGSSALPPLSDSSPSIGNTKPLNDTAYVPCFSNPIDVQRNQEGVFDSFTNSIYAVSSNPMGILPRMPPSGSFYSTQGVQAAPNLAFPGSVYTLQDHTILRTLCENNGYKPERDMISVSQETGLTTDINAETSSNFDMGRRPFENHNHASVSVAPLDLDGLWNY

SEQ ID NO: 1382 - DNA, 1041 bp, Glycine max
  Glyma13g05540.1
atgcaagcaatggagaacattcatcagagggaaatattggaagagcaaaggtttgaattgccaccaggattcaggtttcatccaacagatgaagaactcatcactcactacctctcacagaaggttcttgatagctgcttctgtgccagagccattggagaggctgatttgaacaagtgtgaaccatgggatttgccttggatggccaaaatgggtgaaaaggagtggtattttttctgtgtgagggacagaaaatacccaactggtcaaaggactaatagggccactggtgttggctactggaaggcaacaggcaaggacagagagatatataaggcaaaggcactgattggaatgaagaaaactcttgttttctacaaaggaagagctccaagtggtgaaaaaactagctgggtcatgcatgaatacagattagaagatgaacattctgtgcacaatccacccaaaaaggccatgaatgattgggccatctgcaggatttttcagaagagtaatggtgggaagaaaatgccaatttctgggttggtgagattcagcaattttgcaaaggacatgccttcattgatggattcttctccatacaacgacagtgaatcaaaacctgttttgggggagtcatcacagccaacatgcttctctgatccaaaccaaacggatagctatgaaactctcatgttggcatcttcatattcttcaaacccctctgatatttcccctgcctcatggactttttctaaatctgcccctaccgtgtcccaccaatcactccaagttgggaattcacacagctcagattacttcatgcttcatcaggaacagtccatgttggggatgttgattgaaaaccatggagcaagtgctggccaaagaactcagaaagctcaggatagtaaaggctctgatgctgacatgtcctctgtgatgtacaacaactatgaaatgttccaaagatcatttgggaaccaggaatattcatcaccttccgtaggacatgtgtattctagtggcctatggggattt

SEQ ID NO: 1383 - protein, 347 aa, Glycine max
  Glyma13g05540.1
MQAMENIHQREILEEQRFELPPGFRFHPTDEELITHYLSQKVLDSCFCARAIGEADLNKCEPWDLPWMAKMGEKEWYFFCVRDRKYPTGQRTNRATGVGYWKATGKDREIYKAKALIGMKKTLVFYKGRAPSGEKTSWVMHEYRLEDEHSVHNPPKKAMNDWAICRIFQKSNGGKKMPISGLVRFSNFAKDMPSLMDSSPYNDSESKPVLGESSQPTCFSDPNQTDSYETLMLASSYSSNPSDISPASWTFSKSAPTVSHQSLQVGNSHSSDYFMLHQEQSMLGMLIENHGASAGQRTQKAQDSKGSDADMSSVMYNNYEMFQRSFGNQEYSSPSVGHVYSSGLWGF

SEQ ID NO: 1384 - DNA, 1047 bp, Glycine max
  Glyma19g02850.1
atggaagagcaaaggtttgaattgccaccaggattcaggtttcatccaacagacgaagaactcatcactcactacctctcacagaaggttcttgatagctgcttctgtgcaagagccattggagaggctgatttgaacaagtgtgaaccatgggatttgccttgtatggccaaaatgggtgaaaaggagtggtattttttctgtgtgagggacagaaaatacccaactggtcaaaggactaatagggccactggtgctggatactggaaggccacaggcaaggacagagagatatacaaggcaaagacactgattggaatgaagaaaactctggttttctacaaaggaagagctccaagtggtgaaaaatctaactgggtcatgcatgaatacagattagaaaatgaacattctgtgcaaaatccacccaaaaaggccatgaatgattgggccatctgcaggattttccagaagagtaattgtgggaagaaaatgcccatttctaggttgttgaggttcagcacttttgcaaaggacataccttcattgatggattcttctccaaacaacaacaacaacagtgaatcaaaacctgttttgggggagtcatcacatgcaacctgcttctctgatccaaaccaaagtgaggataaaaaaacagaaaacgaaaacatagctgaaagctatgaaatcatcatgttggcatcttcatattcttcaaacccctctgatgtttcccctgactcatggactttttccaaatctgcccctactgtgtcccaccaatcactccaagttggaaactcacactgctcagattacttcatgcttcatcaggaacagtccatgttggggatgttgattgaaaaccatggatcaagtactggccaaagaactcagaaagctcaggataataataaagactttgatgctgacatgtcctcggtgatgtacaacaacaatgaaatgtttcaaagatcatttgggaaccaggaatattcatcaccttctgtaggacatgtgtattctagtggcctatggggattt

SEQ ID NO: 1385 - protein, 349 aa, Glycine max
  Glyma19g02850.1
MEEQRFELPPGFRFHPTDEELITHYLSQKVLDSCFCARAIGEADLNKCEPWDLPCMAKMGEKEWYFFCVRDRKYPTGQRTNRATGAGYWKATGKDREIYKAKTLIGMKKTLVFYKGRAPSGEKSNWVMHEYRLENEHSVQNPPKKAMNDWAICRIFQKSNCGKKMPISRLLRFSTFAKDIPSLMDSSPNNNNNSESKPVLGESSHATCFSDPNQSEDKKTENENIAESYEIIMLASSYSSNPSDVSPDSWTFSKSAPTVSHQSLQVGNSHCSDYFMLHQEQSMLGMLIENHGSSTGQRTQKAQDNNKDFDADMSSVMYNNNEMFQRSFGNQEYSSPSVGHVYSSGLWGF

SEQ ID NO: 1386 - DNA, 1089 bp, Glycine max
  Glyma09g37050.1
atgggatcaatggagaacgtttccaaaccaaggaaggaaaaccagaagtttgaattgccagcgggttttagatttcatccaagggatgaagaactcataaatcactaccttacaaagaaggttgttgacaactgtttctgtgctgtggccattgctgaggttgatttgaacaagtgtgagccatgggatttgcctgggttggctaaaatgggtgaaactgagtggtattttttctgtgtgagggacagaaaatacccaactggtttaaggactaatagggccactgatgctggttattggaaggccacaggcaaagacagggagatcataatggagaatgcactcattgggatgaagaaaaccttggttttctacaagggaagagctcctaaaggtgaaaagacaaactgggttatgcatgaatataggttggaagggaaacataatcaacccaatcctggaaagagtgaatgggtgatttgtagagtctttgagaagagtccttgtgggaagaaaatgcatgttctaaagtgtggaaggctcaacaactcctctggagaggaaccatcatcatgtgcttctctattgcctcctttgatagattcttctccatacaacagtgaaacaagaaccaccactgctggtgagttgtctcagttgacatgcttctctgatccaaatcaaactgaggatcagaacaacacacatgatgacattgttgatagcatggaaactcctattttgaacttctcaccctcttcaagacctgatgatgcatccactttggccaaagcaaccctttcttcagcttcaaaccaatcagcacagattgcccaccaaattgggaactcacagttcccagattattatcatgtgcctcaagaacagtccatgttgaggatgctgatggaaaaacaaggaccaattgcaaaccaaattcagaaaccagagttttctgagggaagagactttgatgctgatatctcatctatgatctacaacaatgacatgatgcacagaatgtttgggaatcaagaacattcttcagcttctgcagggcccgtggatactgatttcctatggaattac

SEQ ID NO: 1387 - protein, 363 aa, Glycine max
  Glyma09g37050.1
MGSMENVSKPRKENQKFELPAGFRFHPRDEELINHYLTKKVVDNCFCAVAIAEVDLNKCEPWDLPGLAKMGETEWYFFCVRDRKYPTGLRTNRATDAGYWKATGKDREIIMENALIGMKKTLVFYKGRAPKGEKTNWVMHEYRLEGKHNQPNPGKSEWVICRVFEKSPCGKKMHVLKCGRLNNSSGEEPSSCASLLPPLIDSSPYNSETRTTTAGELSQLTCFSDPNQTEDQNNTHDDIVDSMETPILNFSPSSRPDDASTLAKATLSSASNQSAQIAHQIGNSQFPDYYHVPQEQSMLRMLMEKQGPIANQIQKPEFSEGRDFDADISSMIYNNDMMHRMFGNQEHSSASAGPVDTDFLWNY

SEQ ID NO: 1388 - DNA, 1092 bp, Glycine max
  Glyma18g49620.1
atgggatcgatagagaacgcttccaaaccaaggaaggaaaatccgaaatttgaattgccagcgggttttagatttcatccaacagatgaagaactcataaatcaatacctcacaaagaaggttgttgacaactgtttctgtgctatagccattggtgaggttgatttgaacaagtgtgagccatgggatttgcctgggttggctaaaatgggtgaaactgagtggtattttttctgtgtgagggacagaaaattcccaactggtataaggactaatagggccactgatattggttattggaaagccacaggaaaagacaaggagataataatggagaatgcactcattgggatgaagaaaaccttggttttctacaagggaagagctcctaaaggtgaaaagacaaactgggttatgcatgaatataggttggaagggaaacataatcaacccaaacctggaaagagtgaatgggtgatttgtagagtctttgagaagagtcgttgtgggaagaaaatgcatgttccaaagtgtgggaggttcaacaacccctttggagaggaaccatcatcaggtgcttctctattgcctcctttgatggattcttctccatacaacagtgaaacaagaaccaccactgctggggagttgtctcaggtgacatgcttctctgatccaaatcaaactgaggatcagaacaacacacatgatgacattgttgatagcatggaaactcctattttgaacttctcacccttttcaaggcctgatgatgcatccactttggccaaagcaaccctttcttcagcctcaaaccaatcagcacagattgcacaccaaattggggaatcacagttcccagattattgttatgcgcctcaagaaccgtccatgttgaggatgctgatggaaaaccatgaaccctgtgcgaagcaaactcagaaagaagagtttcctgagggaagagactttgatggagatatctcatctatgatatacagcagtgacatgataaacagaatgtttgggaatcaagaacattcttcatcagcttctgcagggcctgtggacactgatttcctatggaattac

SEQ ID NO: 1389 - protein, 364 aa, Glycine max
  Glyma18g49620.1
MGSIENASKPRKENPKFELPAGFRFHPTDEELINQYLTKKVVDNCFCAIAIGEVDLNKCEPWDLPGLAKMGETEWYFFCVRDRKFPTGIRTNRATDIGYWKATGKDKEIIMENALIGMKKTLVFYKGRAPKGEKTNWVMHEYRLEGKHNQPKPGKSEWVICRVFEKSRCGKKMHVPKCGRFNNPFGEEPSSGASLLPPLMDSSPYNSETRTTTAGELSQVTCFSDPNQTEDQNNTHDDIVDSMETPILNFSPFSRPDDASTLAKATLSSASNQSAQIAHQIGESQFPDYCYAPQEPSMLRMLMENHEPCAKQTQKEEFPEGRDFDGDISSMIYSSDMINRMFGNQEHSSSASAGPVDTDFLWNY

SEQ ID NO: 1390 - DNA, 1044 bp, Glycine max
  Glyma05g00930.1
atggaaaacgttccggcggtgtgtaaggaagatgatcagatggatttgcctcccggatttcgattccacccgacggatgaagagctcataagccattacctctacaagaaggtcattgacaccaagttctgcgccagggcaattggagaagtggacctcaacaagtccgagccttgggatttgccatccaaaatgggagaaaaagagtggtactttttctgtgtgagagacagaaaataccccactggcttgagaaccaacagggccacagaagctgggtactggaaggccacagggaaagacaaagagattttcagaggaaaatctttggttggaatgaagaaaactctggttttctacagaggtcgagcacccaaaggagagaaaagcaattgggtcatgcacgagtaccgactcgagggaaaattctctgctcacaacctcccaaaaactgcaaagaacgagtgggtgatttgcagggtgtttcagaagagttcagctgggaagaaaactcatatctcggggataatgaggttggactcttttgctaatgaattgggttcttctgctctgccacccctttcagattcttcgccttctattggcaacactaaacctctgaatgattcggcttacgtgccctgcttctccaatccaattgatgttcaaagaaaccaagaaggtgtcttcgattccttcaccaactctatgtatggggtttcttcaaatcctatggacattcttcccagaatgccaccttctggctccttctactccactcaaggtgttcaagctgcgcctaattttgcatttcctggttctgtttacactcttcaggaccacaccatcctgagagctttgtgtgaaaacaatggttacaagccagagagggacatgatcagtgtttcgcaggaaacgggtctaactactgacatcaacgctgaaacctcttcaaattttgatgtgggttggaggccctttgagaatcacaatcatgcatctgtttctgttgccccattggatcttgatggtttgtggaattac

SEQ ID NO: 1391 - protein, 348 aa, Glycine max
  Glyma05g00930.1
MENVPAVCKEDDQMDLPPGFRFHPTDEELISHYLYKKVIDTKFCARAIGEVDLNKSEPWDLPSKMGEKEWYFFCVRDRKYPTGLRTNRATEAGYWKATGKDKEIFRGKSLVGMKKTLVFYRGRAPKGEKSNWVMHEYRLEGKFSAHNLPKTAKNEWVICRVFQKSSAGKKTHISGIMRLDSFANELGSSALPPLSDSSPSIGNTKPLNDSAYVPCFSNPIDVQRNQEGVFDSFTNSMYGVSSNPMDILPRMPPSGSFYSTQGVQAAPNFAFPGSVYTLQDHTILRALCENNGYKPERDMISVSQETGLTTDINAETSSNFDVGWRPFENHNHASVSVAPLDLDGLWNY

SEQ ID NO: 1392 - DNA, 957 bp, Solanum lycopersicum
  Solyc02g088180.2.1
atggaaattgtgtgtggatttggtggtcgagaagaagaaatggaattacctccaggttttcgatttcatccgactgatgaagagcttataacacactatttagccccaaaggttcttgacagtggcttttgtgctatagctattggtgaggtagatttgaacaaagttgaaccatgggatttgccatggaaggcaaaaatgggtgaaaaagaatggtacttcttttgtatgagagacaagaaatatccaacaggacagaggacaaacagagcaacagaagcagggtattggaaggcaacaggcaaagataaggaaatattcaagtcaaaaacacttgttggtatgaagaaaactcttgttttctataaaggaagagcacctagaggtgaaaaaactaattgggtcatgcatgaatatagattagatggaaaatattctatccataatctcccaaaaactgctaagaacgaatgtgtgatttgtagaattttcaaaaagaattcaggagggaaaaagatagcaatctcaaatcttacgagaagcgatagtataacagataattcaaggtcttcaaatttgccaccattaatggacttgtcaccatacaacaagattacaacaacagcgagaagtagtggagagacatgtaattcacatgtgacgtgtttctccgattcaatggaggatcaaaaacctcaaacttatgatcatcatcatcttctatcaagttcccctgtttcagtcgatttcccccaaaacgtaccgaacgattcgatgacctacatgggaaatttccagtatggagattctggattgatgcaagataattcgattatgaggcttttgatagataacaattatgggtcagaatcaaaacaaagtttgagaggttacgaagatcatgacatcaatatcagttcaactggcccagtggacatcgattgtctatggaattat

SEQ ID NO: 1393 - protein, 319 aa, Solanum lycopersicum
  Solyc02g088180.2.1
MEIVCGFGGREEEMELPPGFRFHPTDEELITHYLAPKVLDSGFCAIAIGEVDLNKVEPWDLPWKAKMGEKEWYFFCMRDKKYPTGQRTNRATEAGYWKATGKDKEIFKSKTLVGMKKTLVFYKGRAPRGEKTNWVMHEYRLDGKYSIHNLPKTAKNECVICRIFKKNSGGKKIAISNLTRSDSITDNSRSSNLPPLMDLSPYNKITTTARSSGETCNSHVTCFSDSMEDQKPQTYDHHHLLSSSPVSVDFPQNVPNDSMTYMGNFQYGDSGLMQDNSIMRLLIDNNYGSESKQSLRGYEDHDINISSTGPVDIDCLWNY

SEQ ID NO: 1394 - DNA, 978 bp, Solanum lycopersicum
  Solyc03g115850.2.1
atggagaatttttctgcaagtgttaagatggatgatcaacagcagatggaacttccgccgggatttcgctttcatcctacagatgaagagctaattactcattatttgtctaagaaagtggttgatatgaatttctctgctattgctattggagatgttgacatgaacaaaattgaaccttgggagcttccatggaaggcgaaaattggggaaaaagaatggtactttttttgtgtgagagacaagaagtatccaactggtttgaggacaaacagggcaactgctgcaggttactggaaagctacaggaaaagacaaggagatttttagaggaagatctcttgttgggatgaagaaaactttggttttttacagaggaagggctccaagaggtgaaaaaacaaattgggtaactcatgaatatagattagaaggaagattatcactaaacaatcttcctaaaacagtaaagaatgattgggtgatttgcagagtatttcaaaaaacaactggtggaaaaaaaattcacatttcagggcttgtgagagctaattctgatgaaaatgaaatggtcaataccgttttgccaccattgacagattcatcgcctagccacgtgcactgcttctccaattatgttactactcaaaagaatcaagaaaacaacatgatcaattccttcaacaattcacctaatttccctcttctctcgaattccatcgacattttccaaagaaactctcttccgacttcgttcacctggaaccaaaatgtccctcttcaacacaattttcctcagccaggttcatttcctatacaagatcccgcaacgctaaggaatttgcttgaaaattacggacatcagagtttcaaaaaggagacagacatgatcagtgtatcccaagaaacaggtataagcactgataggaacactgaaatcacatcagctcaacaagatcttgattgcttctggacttac

SEQ ID NO: 1395 - protein, 326 aa, Solanum lycopersicum
  Solyc03g115850.2.1
MENFSASVKMDDQQQMELPPGFRFHPTDEELITHYLSKKVVDMNFSAIAIGDVDMNKIEPWELPWKAKIGEKEWYFFCVRDKKYPTGLRTNRATAAGYWKATGKDKEIFRGRSLVGMKKTLVFYRGRAPRGEKTNWVTHEYRLEGRLSLNNLPKTVKNDWVICRVFQKTTGGKKIHISGLVRANSDENEMVNTVLPPLTDSSPSHVHCFSNYVTTQKNQENNMINSFNNSPNFPLLSNSIDIFQRNSLPTSFTWNQNVPLQHNFPQPGSFPIQDPATLRNLLENYGHQSFKKETDMISVSQETGISTDRNTEITSAQQDLDCFWTY

SEQ ID NO: 1396 - DNA, 1017 bp, Solanum lycopersicum
  Solyc06g069710.2.1
atggagaattattcaggagttgttaaggatgatgatcagatggagttaccacctggatttcgatttcatccaactgatgaagaattgatcactcattatttgtctaacaaagttgtggatactaatttcgttgctattgctattggtgatgttgatttgaacaaagttgaaccttgggaccttccatggaaggcgaaaatgggggaaaaagaatggtattttttctgtgtgagagacaagaagtatccaacagggctgagaacaaacagggcaactgctgcagggtattggaaagctactggaaaagacagagagattttcaggggaaaatcattggttggtatgaagaaaactctggttttctacaaagggagagctccaaaaggtgaaaagacaaattgggttattcatgaatttagattagaaggaaaattgtctcttcaaaatctgccaaagacagcaaagaatgaatgggtgatttgcagagtgtttcaaaagagcagtggtggaaagaaaatccacatttcagggcttttgaaactgaattctaatgaaaatgaaatggggaattcatttctgccaccattgacagattctgctactgctactgcttcgaaatccagccacgtgcactgcttctccaattttctcactgctcaaaacaactgtttccctcttctgtcaaatccaatggatagttaccctacaacttctcttgttccaaatacattttcttgtaaccaaatagctccattcactactactaataatccagcttcatttggggttcaagatccttcaattcttctaaggacttcacttgacagctatggtctgaatttcaagaaagaggacatttttaatgtaccccaagaaacaggggtaattagcactgacatgaatactgatatcacctcagtcgtatcaaatcttgaaatgaaaagaaggtttcttgaagatcaggtgccatcagcaggtatggttggattacagggtcttgattgtctctggagttgc

SEQ ID NO: 1397 - protein, 339 aa, Solanum lycopersicum
  Solyc06g069710.2.1
MENYSGVVKDDDQMELPPGFRFHPTDEELITHYLSNKVVDTNFVAIAIGDVDLNKVEPWDLPWKAKMGEKEWYFFCVRDKKYPTGLRTNRATAAGYWKATGKDREIFRGKSLVGMKKTLVFYKGRAPKGEKTNWVIHEFRLEGKLSLQNLPKTAKNEWVICRVFQKSSGGKKIHISGLLKLNSNENEMGNSFLPPLTDSATATASKSSHVHCFSNFLTAQNNCFPLLSNPMDSYPTTSLVPNTFSCNQIAPFTTTNNPASFGVQDPSILLRTSLDSYGLNFKKEDIFNVPQETGVISTDMNTDITSVVSNLEMKRRFLEDQVPSAGMVGLQGLDCLWSC

SEQ ID NO: 1398 - DNA, 1077 bp, Populus trichocarpa
  POPTR_0012s01610.1
atggaaaacatttctggacttggcaaggaagatgatgataagatggatttgcctcctggattccggttccatccgactgacgaagagcttatttctcactacttatacaagaaggttcttgacatcaacttctctgctagagcaatcggagatgtggacttgaacaagtctgaaccctgggaactgccatggaaggcgaagatgggagagaaagagtggtactttttctgtgttagggacagaaagtacccaacaggtctcagaacaaatagggcaactgaagctggttactggaaagccacggggaaagataaggagatctacagaggaaaatccctggttggaatgaaaaagacccttgttttctacaagggcagagcccctaaaggagagaaaaccaactgggtcatgcatgaatacagattagagggtaaattctctgcccacaatctccccaaaactgccaagaatgaatgggtgatttgcagggtgtttcaaaagagctcggctggaaagaagacctatatttcaggtctagtgagactaggttcttttggtaatgaatttagcccttatggtctgccaccattgacggattcttcaccctccaatggcaagattaggccggtggccgagtcggcctacgtgccctgcttctccaatctcagtgatgatcaaagaaaccaacaagacacaactgatagcttcaacaatcatctttttgcagtttcttcgaacccttcagaggtttttcctcgaatcccacttctgaattcattctactctccccaggctgtcgcagcatcaggaaatttgcaatatccaggttctgtttcaattcaagaccgctcagttttaaaagccttgattgagaaccaaggctcaaacatgaagcagcaaagttccaagcttgaaagggacatggccagtgtctcacaagatagcgctgcagatatgaacaatgaaatctcttctgtcatatcaaatcttgaagcgggaaaaaggtcatttgatgaacaagaggcaccaccttgtacattagtccaatcaatggaccttgattgtttctggaactat

SEQ ID NO: 1399 - protein, 359 aa, Populus trichocarpa
  POPTR_0012s01610.1
MENISGLGKEDDDKMDLPPGFRFHPTDEELISHYLYKKVLDINFSARAIGDVDLNKSEPWELPWKAKMGEKEWYFFCVRDRKYPTGLRTNRATEAGYWKATGKDKEIYRGKSLVGMKKTLVFYKGRAPKGEKTNWVMHEYRLEGKFSAHNLPKTAKNEWVICRVFQKSSAGKKTYISGLVRLGSFGNEFSPYGLPPLTDSSPSNGKIRPVAESAYVPCFSNLSDDQRNQQDTTDSFNNHLFAVSSNPSEVFPRIPLLNSFYSPQAVAASGNLQYPGSVSIQDRSVLKALIENQGSNMKQQSSKLERDMASVSQDSAADMNNEISSVISNLEAGKRSFDEQEAPPCTLVQSMDLDCFWNY

SEQ ID NO: 1400 - DNA, 1077 bp, Populus trichocarpa
  POPTR_0015s02170.1
atggaaaacatttctgggcttggtaaggaaggtgatgatcagatggatttgcctcctggattccggttccatccaaccgatgaagagcttatctctcactacttatacaagaaggttcttgacatcaccttctcggctaaagcaattggagatgtggatttgaacaagtctgaaccctgggaactgccatggaaagcgaagatgggagagaaagagtggtactttttctgtgtcagggacagaaagtaccctacaggtctcaggacaaatagggcaacagaagctggttactggaaagccacagggaaagacaaggagatctatagaggaaaattcctggttggaatgaaaaagacccttgtattctacaagggtagagcccctaaaggagggaaaaccaattgggtcatgcatgaatacagattagagggtaaattttctgtccataatctccccaaaactgccaagaatgaatgggtgatctgcagggtgtttcaaaagagttctgctggaaagaaaacccatatttcaggtctagtgagattaggctcgtttagtaatgaatttagcccttctggtctgccaccattgatggattcttcaccctacaattgcaagattaagccagtggccgagtcggcctacgtgccctgcttctccaatcccattaatgttcaaagaaaccaacaagacacgattgatagctttgacaatcatcttttagcattttcaacaaaccctttagaggtttttccacgaatcccacttttgaatccattctacactcctcaggctgtcccggtatcaggaaacttacaatatccaggttctgttttaatgcaagaccactcgatcttaagagccttgattgcaaaccaaggcacaaacatgaagcagcaaagtttcaagattgaaagggatatggtcggtgtctcacaagacagtactacagatatgaatactgaaatctattcagtcatatcaaatcttgaagtgggaaaaaggtcaggtgatgatcaagatgcaacaccttctacattagttgcatcaacggaccttgattctttttggaactat

SEQ ID NO: 1401 - protein, 359 aa, Populus trichocarpa
  POPTR_0015s02170.1
MENISGLGKEGDDQMDLPPGFRFHPTDEELISHYLYKKVLDITFSAKAIGDVDLNKSEPWELPWKAKMGEKEWYFFCVRDRKYPTGLRTNRATEAGYWKATGKDKEIYRGKFLVGMKKTLVFYKGRAPKGGKTNWVMHEYRLEGKFSVHNLPKTAKNEWVICRVFQKSSAGKKTHISGLVRLGSFSNEFSPSGLPPLMDSSPYNCKIKPVAESAYVPCFSNPINVQRNQQDTIDSFDNHLLAFSTNPLEVFPRIPLLNPFYTPQAVPVSGNLQYPGSVLMQDHSILRALIANQGTNMKQQSFKIERDMVGVSQDSTTDMNTEIYSVISNLEVGKRSGDDQDATPSTLVASTDLDSFWNY

SEQ ID NO: 1402 - DNA, 927 bp, Populus trichocarpa
  POPTR_0017s12210.1
atggaaaacaattgtgtgtatagtgaggaagatgagcagatggaattgcctccgggatttagattccatccaactgatgaagagctcataactcactacctgtctcagaaggttctggacaactacttttgtgctagagctattggtgaggtcgatttaaacaagtgtgagccatgggatttgccttggagggctaaaatgggtgaaaaggaatggtatttcttctgtgttatagaccggaagtatcccaccggtttaaggacgaatagggctactgatgctggttattggaaagccacaggcaaagacaaggaaatttacagggctaaaacacttgttggcatgaagaagaccttggttttctacaaagggagagcccccaaaggagaaaaaaccaactgggttatgcatgagtatagattagaggggaaaaaccccgtctataatccccctaaaacagcaaagaatgattgggtcatctgtagaatttttgagaagagttgtggaggaaagaaaacacatatttcagggttggtgaggttaagctcgtatggaaatgaattaaagccaacaatattgcctccattgatggattcttctcaacacaataacgacaagaggactaacatagttctgttttcaaaaccctcacctccaaactctttctattcctctcatattttaccaaacatagcaaattttcaatacccagattctgttatgatgccagaacactccatgttgaggatattgcttgaaaaccaaggacccggcatgaacctaaactcaaaacgggagctctcagaggacactggcctcagcactgatatgtcttcagtggtaaccaaccatgaattggttcatgggtcctttgaggatccatcaagttctgccggaccagttgatcttgattacctttggaattac

SEQ ID NO: 1403 - protein, 309 aa, Populus trichocarpa
  POPTR_0017s12210.1
MENNCVYSEEDEQMELPPGFRFHPTDEELITHYLSQKVLDNYFCARAIGEVDLNKCEPWDLPWRAKMGEKEWYFFCVIDRKYPTGLRTNRATDAGYWKATGKDKEIYRAKTLVGMKKTLVFYKGRAPKGEKTNWVMHEYRLEGKNPVYNPPKTAKNDWVICRIFEKSCGGKKTHISGLVRLSSYGNELKPTILPPLMDSSQHNNDKRTNIVLFSKPSPPNSFYSSHILPNIANFQYPDSVMMPEHSMLRILLENQGPGMNLNSKRELSEDTGLSTDMSSVVTNHELVHGSFEDPSSSAGPVDLDYLWNY

SEQ ID NO: 1404 - DNA, 870 bp, Vitis vinifera
  GSVIVT01011445001
atggaaaaggctcctgaccagagtaaggatgatgagatgatggaactgcctcctgggttccgattccatcctacggatgaggagctcatcactcactacctgtcccaaaaggttctgaatagcggtttctgcgctgtagccatcggagaggtggatttgaacaagtgtgaaccctgggatttgccatggaaagcaaaaatgggtgagaaagaatggtacttcttctgtgttagagacagaaaatatcccactggtttgaggacaaacagggcaaccgatgccggttattggaaggccacaggcaaagataaggagatttacaagatgaaaacattggtggggatgaagaaaaccttggttttctacaaaggaagagcccctaaaggtgaaaagaccaactgggtcatgcatgaatacagattagaagggaaacattccatgtacaatctccctaaaacaaccaagaatgagtgggtgatctgcagggtcttccagaagagctcaggtgggaagaaaacacatatttcagggctgctgcctccattgacagactcttctccgttcagcagcgaaacgagaacagtcgctgcctcttcttcctcctcaaacccctctgatatctccccggcttcactgcttttctccaaattccccttcccaaactcattccacactccccaaaatccactaaaccttggaaactgtcaattcccagactcctttctcatccctgaccagtccatactgaggattctccttgaaaaccagggatccgacatgaaaccatcctcgaaaacagagtctttcgaagatcaaaatgatccatccacttcagctgggcctgtagacattgattgcctctggaattac

SEQ ID NO: 1405 - protein, 290 aa, Vitis vinifera
  GSVIVT01011445001
MEKAPDQSKDDEMMELPPGFRFHPTDEELITHYLSQKVLNSGFCAVAIGEVDLNKCEPWDLPWKAKMGEKEWYFFCVRDRKYPTGLRTNRATDAGYWKATGKDKEIYKMKTLVGMKKTLVFYKGRAPKGEKTNWVMHEYRLEGKHSMYNLPKTTKNEWVICRVFQKSSGGKKTHISGLLPPLTDSSPFSSETRTVAASSSSSNPSDISPASLLFSKFPFPNSFHTPQNPLNLGNCQFPDSFLIPDQSILRILLENQGSDMKPSSKTESFEDQNDPSTSAGPVDIDCLWNY

SEQ ID NO: 1406 - DNA, 852 bp, Vitis vinifera
  GSVIVT01007982001
atgattttgcctccgggatttcgatttcatcccacggatgaggagcttatcactcactatttatccaaaaaggttattgattccaacttcagtgctagagctattggacaggtgaatttgaacaactccgagccttgggagttgcctgggaaagcgaaaatgggagaaaaggagtggtactttttctgtgtcagagacaggaaataccctactggtctgaggacaaacagggctactgaggctggctactggaaagccacagggaaggacaaggagattttcagaggaaaatctctggtcggaatgaagaaaaccctggtcttctacgcggggagggctccaaagggagagaaaaccaattgggtgatgcacgaatacagattggagggtaaattctctctccataacctccctcaaacagcaaagaatgaatgggtgatttgcagggtattccaaaagagttccggtgggaagaaaacccatatttcagggatagggagattaagctcttatggaaatgaattgaatccttctgttctgccaccgctaatggatgcttcggcagcttacaaccccaggaccagacctgccacttcgcaatcacctcacgtgccctgcttctccaaccccatcgatattccacctcccaaaccccttttactcatctcatgctgccacaattccaggaactctgcaataccccacttccttcctaatgcaagaccagccaagcctaagggctttactggagaaccatggatcaaacatgaggcagagccagaaactagagagggagatgatcagcagaccattcgaagatcaacacgtcccatctacttcagtcggacctgt

SEQ ID NO: 1407 - protein, 284 aa, Vitis vinifera
  GSVIVT01007982001
MILPPGFRFHPTDEELITHYLSKKVIDSNFSARAIGQVNLNNSEPWELPGKAKMGEKEWYFFCVRDRKYPTGLRTNRATEAGYWKATGKDKEIFRGKSLVGMKKTLVFYAGRAPKGEKTNWVMHEYRLEGKFSLHNLPQTAKNEWVICRVFQKSSGGKKTHISGIGRLSSYGNELNPSVLPPLMDASAAYNPRTRPATSQSPHVPCFSNPIDIPPPKPLLLISCCHNSRNSAIPHFLPNARPAKPKGFTGEPWIKHEAEPETREGDDQQTIRRSTRPIYFSRTC

SEQ ID NO: 1408 - DNA, 1095 bp, Citrus clementina
  clementine0.9_013688m
atggaaaacgtttctggagttggaaaggaagatgaccagatggatttgccgcctggtttcagattccatccaactgacgaagagcttatcactcactatttgtacaagaaagttcttgatgtttgcttctcttgtagagctattggagatgttgatctgaacaaaaatgaaccttgggaattgccttggaaagcaaagatgggagagaaagaatggtactttttctgcatgagggataggaaatatccaactggtttgaggactaacagggcgactgtatctggttattggaaagccacggggaaagacaaggagatttacagaggaaaatctctagttggaatgaaaaagactcttgttttttacaggggaagagccccaaaaggggagaaatcaagctgggtcatgcacgaatacagattggacggcaaattctctgttcatagtctccccaaaactgccaaaaatgagtgggtgctttgccgggtgtttcagaagggttctggtgggaaaaagactcatatttcagggctagcgggattagggtcttttggaaatgaattgggtcctcctggcttgccaccattaatggattcatctcctgataatggcagcaagaccatcaaatctgttgccgattcggcttacgtgtcctgcttctccaattctattgatcttcaaagaaatcaaaaaaccaccaccaccattgaaaattttttcaacaatcctcctcccatctctgtgtcttcaaactgtcctgatgtttttccaagaatcccactctcttcaaactcattctattctcctttatcggtcccggttccatcacacgcgcaattcccaggctctgttttcatgcaagaccactcaatcttaagggccttaattgaaaaccaaggatcaaacatgagccagagtttcaaaacagaaagggaaatgatcagtgtttcacaagacacaggcctcactgctgacatgaaccctgaaatctcctcagttgtgtccaaccttgaaatggtgaagaggccatttaatgatcatgatgctccttcaacttcagctggaccagtggattttgactgtttttggaattac

SEQ ID NO: 1409 - protein, 365 aa, Citrus clementina
  clementine0.9_013688m
MENVSGVGKEDDQMDLPPGFRFHPTDEELITHYLYKKVLDVCFSCRAIGDVDLNKNEPWELPWKAKMGEKEWYFFCMRDRKYPTGLRTNRATVSGYWKATGKDKEIYRGKSLVGMKKTLVFYRGRAPKGEKSSWVMHEYRLDGKFSVHSLPKTAKNEWVLCRVFQKGSGGKKTHISGLAGLGSFGNELGPPGLPPLMDSSPDNGSKTIKSVADSAYVSCFSNSIDLQRNQKTTTTIENFFNNPPPISVSSNCPDVFPRIPLSSNSFYSPLSVPVPSHAQFPGSVFMQDHSILRALIENQGSNMSQSFKTEREMISVSQDTGLTADMNPEISSVVSNLEMVKRPFNDHDAPSTSAGPVDFDCFWNY

SEQ ID NO: 1410 - DNA, 1044 bp, Citrus clementina
  clementine0.9_014567m
atggagaaatatgacgatcaagaacagattgaattgcctccaggatttcggttccatcccacggatgaagagcttataactcattacttaacaccaaaggtttttgatggttgtttttcagctagagctatcggtgaagttgatttgaacaagtgtgagccctgggatttgcctcggagagctaaaatgggtgaaaaggaatggtattttttttgtgttagggacagaaagtacccaactggattgagaacaaatagagctactgaagcaggatactggaaagccacaggcaaagataaggagatttacaaagcaaaagcacttgtggggatgaagaaaactttggttttttacaaaggaagagccccgaaaggtcaaaaaaccaactgggtcatgcatgaatatcgtttagaaggcaaatattctgcctacgatcaccccaaaacagccaaaaatgagtgggtgatttgtagggtgtttcaaaagagtggtggaggaaagaaaacacatattcaagggatggtgaaattaggctcattcgggaacggcatgggctcttctgcgttgcctccattgatggattcatctccttacaatagtgaaacgagaaccaccattaatgaaacctttcacgtgacctgcttctccgatgccctggaggaccagaaagctcaggaagacatgatcgatagctttaacaactctcttttagcttcttcatcttcctcaaaccctcactccgaaatctcccctgcctcaattttcttgtccaaatcctctttttcaaactcactctacgccgatcaaattctcccacgtattgcaaatatgcaatacccagattcttttttgatgcaagaccaatccattttgaagatgttgctggagaatcatggacccaacatgaagaaaaattcaaaagcagagttctcacaggatgattcagttgtgtcaaatcatgaattcattcaagggtcatttgatgatcaagaggacccgtcaagttctgctggcccagtagcccttgattgtctttggaattat

SEQ ID NO: 1411 - protein, 348 aa, Citrus clementina
  clementine0.9_014567m
MEKYDDQEQIELPPGFRFHPTDEELITHYLTPKVFDGCFSARAIGEVDLNKCEPWDLPRRAKMGEKEWYFFCVRDRKYPTGLRTNRATEAGYWKATGKDKEIYKAKALVGMKKTLVFYKGRAPKGQKTNWVMHEYRLEGKYSAYDHPKTAKNEWVICRVFQKSGGGKKTHIQGMVKLGSFGNGMGSSALPPLMDSSPYNSETRTTINETFHVTCFSDALEDQKAQEDMIDSFNNSLLASSSSSNPHSEISPASIFLSKSSFSNSLYADQILPRIANMQYPDSFLMQDQSILKMLLENHGPNMKKNSKAEFSQDDSVVSNHEFIQGSFDDQEDPSSSAGPVALDCLWNY

SEQ ID NO: 1412 - DNA, 1194 bp, Citrus clementina
  clementine0.9_012151m
atggaaaacgtttctggagttggaaaggaagatgaccagatggatttgccgcctggtttcagattccatccaactgacgaagagcttatcactcactatttgtacaagaaagttcttgatgtttgcttctcttgtagagctattggagatgttgatctgaacaaaaatgaaccttgggaattgccttggaaagcaaagatgggagagaaagaatggtactttttctgcatgagggataggaaatatccaactggtttgaggactaacagggcgactgtatctggttattggaaagccacggggaaagacaaggagatttacagaggaaaatctctagttggaatgaaaaagactcttgttttttacaggggaagagccccaaaaggggagaaatcaagctgggtcatgcacgaatacagattggacggcaaattctctgttcatagtctccccaaaactgccaaagtttgtgccttttccgctgttttttcccctgttttttttcctctgtttttgtcaactctgtttttgttaactctgtttttgtgttttcttgttatgcagaatgagtgggtgctttgccgggtgtttcagaagggttctggtgggaaaaagactcatatttcagggctagcgggattagggtcttttggaaatgaattgggtcctcctggcttgccaccattaatggattcatctcctgataatggcagcaagaccatcaaatctgttgccgattcggcttacgtgtcctgcttctccaattctattgatcttcaaagaaatcaaaaaaccaccaccaccattgaaaattttttcaacaatcctcctcccatctctgtgtcttcaaactgtcctgatgtttttccaagaatcccactctcttcaaactcattctattctcctttatcggtcccggttccatcacacgcgcaattcccaggctctgttttcatgcaagaccactcaatcttaagggccttaattgaaaaccaaggatcaaacatgagccagagtttcaaaacagaaagggaaatgatcagtgtttcacaagacacaggcctcactgctgacatgaaccctgaaatctcctcagttgtgtccaaccttgaaatggtgaagaggccatttaatgatcatgatgctccttcaacttcagctggaccagtggattttgactgtttttggaattac

SEQ ID NO: 1413 - protein, 398 aa, Citrus clementina
  clementine0.9_012151m
MENVSGVGKEDDQMDLPPGFRFHPTDEELITHYLYKKVLDVCFSCRAIGDVDLNKNEPWELPWKAKMGEKEWYFFCMRDRKYPTGLRTNRATVSGYWKATGKDKEIYRGKSLVGMKKTLVFYRGRAPKGEKSSWVMHEYRLDGKFSVHSLPKTAKVCAFSAVFSPVFFPLFLSTLFLLTLFLCFLVMQNEWVLCRVFQKGSGGKKTHISGLAGLGSFGNELGPPGLPPLMDSSPDNGSKTIKSVADSAYVSCFSNSIDLQRNQKTTTTIENFFNNPPPISVSSNCPDVFPRIPLSSNSFYSPLSVPVPSHAQFPGSVFMQDHSILRALIENQGSNMSQSFKTEREMISVSQDTGLTADMNPEISSVVSNLEMVKRPFNDHDAPSTSAGPVDFDCFWNY

SEQ ID NO: 1414 - DNA, 915 bp, Eucalyptus grandis
  Eucgr.I01958.1
atgatgagcggcaccatgattttcgaaggagatgaacagatggaattgcctccggggtttcgattccacccgactgacgaagagctgatcactcactacctcaccccaaaagttcttgacggcagcttccgtgcaagagccatgggggaggttgatttaaacaagtgcgaaccgtgggacttgcctgggcaagcaaaaatgggcgaaaaggaatggtacttcttctgtgtgagagacaggaagtacccgaccggtatgaggacgaatagagctaccgaagccggctattggaaagccaccggtaaagacaaggagatccgcaggatgaagaaggtggtcgggatgaagaaaactctcgttttctacaggggaagagctcctaatggtcagaagaccaactgggtcatgcacgaattcaggctaggagacggctattatcaacaccatctttccaactcacaaaagaacgactgggtcatttgcagaatctttgaaaaaggacctgatgggaagaaagctgatcagcctgagactctgcctggcggtctagagaggctgagctcgtttgacaacgaaccgaaagcatctcttttgcctctgcctccactggtggagtcgtctccattcaccaccacctccttctccgatcgacccgaggatcgcaatgctcagaagacttccctcttctcttctccatcttcatcggagctagaccagtctctcggccccgcgcattcgttcggctggtcggacacggtcttcatgcacgagcaggcaattctgaggatgctgctcgagaactcggcgtcaaacgcgaaggctgagtacgcagacttctcgcaagcaagacgccaggacagagaggcgacgatgccgacgtcttttcagtgcgatgtggattgcctttggagaaac

SEQ ID NO: 1415 - protein, 305 aa, Eucalyptus grandis
  Eucgr.I01958.1
MMSGTMIFEGDEQMELPPGFRFHPTDEELITHYLTPKVLDGSFRARAMGEVDLNKCEPWDLPGQAKMGEKEWYFFCVRDRKYPTGMRTNRATEAGYWKATGKDKEIRRMKKVVGMKKTLVFYRGRAPNGQKTNWVMHEFRLGDGYYQHHLSNSQKNDWVICRIFEKGPDGKKADQPETLPGGLERLSSFDNEPKASLLPLPPLVESSPFTTTSFSDRPEDRNAQKTSLFSSPSSSELDQSLGPAHSFGWSDTVFMHEQAILRMLLENSASNAKAEYADFSQARRQDREATMPTSFQCDVDCLWRN

SEQ ID NO: 1416 - DNA, 1083 bp, Eucalyptus grandis
  AT5G07680.1
atggagaacatggctaggctcgggaaggaagacgatcagatagagttgccgccggggttcaggttccacccgacggacgaagagctcatcacccattatctgcagaagaaggtgggggacactggcttctccgccaaagccatcggagaagtggatttgaacaagtccgagccctgggatttgccttggaaggcgaaaatgggggagaaggaatggtatttcttctgcctgagggacagaaaatacccgactggtttgaggaccaacagagccaccgaatctggttactggaaggccacggggaaagacaaggagatctacaggggaaaatctctggttggtatgaagaaaaccttggttttctacagagggagggctccaaagggggagaagacgaattgggtcatgcatgaatacagattggaaggaaaactctctctgaattatctccccagggcttcgaagaacgagtgggtcatttgcagggtcttccagaagagctctggtgggaagaaaatccacatctcgagcctcgtggcggcggggtctctcgagaacgaaatgagctccggcttgccgccgttaacggattcctctcctcacgattcgaagacggaatccaaccccggatcggcttacgtgccctgcttctccagcccaacagagttcgaaaggaacaaggaaaacacgaacaattacttcaacaatcccatgttccccatctcctcgaaccccacgaacaccacccccaaaatctcgctcttgagcccagtgtaccctcaccaggccatccccgtcccagccaattggcaacacccggggggctccgtcttcatgcccgagcactcggtcctcagggctctgctcgagggcaccgggctgaacgcgaggcagagcgcgagggcggagcgggaggcgatcagcatctcccaagagacagcgctgaccaacgacttgaacaccgagatctcctccgtcatgcaggatttcgaaatggggaggaggcagttcgaggatcagcagcaagttccatcgaccttagctggaccaatggacgtggacctcctctggaactattcaagt

SEQ ID NO: 1417 - protein, 361 aa, Eucalyptus grandis
  Eucgr.B00529.1
MENMARLGKEDDQIELPPGFRFHPTDEELITHYLQKKVGDTGFSAKAIGEVDLNKSEPWDLPWKAKMGEKEWYFFCLRDRKYPTGLRTNRATESGYWKATGKDKEIYRGKSLVGMKKTLVFYRGRAPKGEKTNWVMHEYRLEGKLSLNYLPRASKNEWVICRVFQKSSGGKKIHISSLVAAGSLENEMSSGLPPLTDSSPHDSKTESNPGSAYVPCFSSPTEFERNKENTNNYFNNPMFPISSNPTNTTPKISLLSPVYPHQAIPVPANWQHPGGSVFMPEHSVLRALLEGTGLNARQSARAEREAISISQETALTNDLNTEISSVMQDFEMGRRQFEDQQQVPSTLAGPMDVDLLWNYSS

SEQ ID NO: 1418 - DNA, 1032 bp, Brachypodium distachyon
  Bradi3g46900.1
atggagcatgacgtgcaccagcagcagctggaggagcccatggagctcccgccgggcttccggttccaccccaccgacgaggagctcgtcacgcactatctcgcccggaagaccgccgaccccacgggcttcgccgcccgcgccgtcggagaggccgacctgaacaagtgcgagccatgggacctgccatctcgggcaacgatgggggagaaggagtggtacttcttcgtggtgaaggaccgcaagtacccgacggggacgaggacgaaccgggcgacggagtccgggtactggaaggcgacgggcaaggacagggagatcctgaggggcaaggccctggtcggcatgaagaagacgctcgtcttctacacggggagggcccccaagggcggcaagaccggctgggtcatgcacgagtaccgcctcgagggcaagcacgcccccgcgccctacagcctccccagggctgccacatccaaggacgagtgggtgctgtgccgggtgttcaagaagagcctcgagccgtcggcggccggcagcaataacggcgccaggaaaggcgcgtgcacggggatggcggcggacgccgtagggtcctccatgtccctggccgacgccggccttgccgcgctacctccgctgatcgacgtggccgccagcggcagcttcgcgccaccgccagcggcacacgtgacctgcttctccaacgcgctggagggccagttcctgaacccgccgttcctgctcccggcgacgacggccgcggctgcacatagcgccggggaaaatatacacatcgccatggaatccgccgcctcgcccttctttgccagcatgtacacgcaggacgtttcggggggcatggcgcacgagttcctcctggacggcggcggcggcggatggtactccaagggcgagcgggagaggctgagcggcgcctcgcaggacaccggcctcacctcggaggtgaaccccaccgagatctcctcgtcgcggcaacacatggatcatgagccgaccttttggggctat

SEQ ID NO: 1419 - protein, 344 aa, Brachypodium distachyon
  Bradi3g46900.1
MEHDVHQQQLEEPMELPPGFRFHPTDEELVTHYLARKTADPTGFAARAVGEADLNKCEPWDLPSRATMGEKEWYFFVVKDRKYPTGTRTNRATESGYWKATGKDREILRGKALVGMKKTLVFYTGRAPKGGKTGWVMHEYRLEGKHAPAPYSLPRAATSKDEWVLCRVFKKSLEPSAAGSNNGARKGACTGMAADAVGSSMSLADAGLAALPPLIDVAASGSFAPPPAAHVTCFSNALEGQFLNPPFLLPATTAAAAHSAGENIHIAMESAASPFFASMYTQDVSGGMAHEFLLDGGGGGWYSKGERERLSGASQDTGLTSEVNPTEISSSRQHMDHEPTFWGY

SEQ ID NO: 1420 - DNA, 996 bp, Brachypodium distachyon
  Bradi5g12407.1
atggacctcccgccgggcttccgcttccacccgacggacgaggagctcatcacgcactacctggccaagaaggtcgccgacgcccgcttcacggcgttcgccgtctccgaggccgacctcaacaagtgcgagccatgggacctgccatcgctggctaggatgggggagaaggaatggtacttcttctgcctcaaggaccgcaagtacccgacgggcctgaggacgaaccgggcgacggagtccgggtactggaaggccacgggcaaggacaaggacatcttcaggggcaagggaaccctcgtcggcatgaagaagacgctcgtcttctacacggggcgtgcgcccaagggcgagaagtccggctgggtcatgcacgagtaccgcctccacggcaagtccaccgcatcgtccaagaacgagtgggtgttgtgcagggtgttcaagaagagcctggtgggcgtagtagcgtcgtcggcgtcggcgtcggcggcagtgaagaaaggcgccatggggatggaagacacgatagggacgtcctccatggccgccgtcggtactacacagctccctccgctcttggacatgtccggctccggcttcgtcgacccggccgctgcacacgtgacctgcttctccaacaacgcgctggaggcggcgggcggccacggccacggccacggccacttcttcaacagcgcaacagccgacgatcaccatcacggcggcctaggcgccgcgtcctcctcttccacgccgttcttggcgaactacgcgcagtacgggctggtgcagctcctcgagagcagcagcgggtaccgcggcctcgacatggcagcgccgtgcaagcagcagcagcagccggccgctgccgcgtgcaaggagatgctgatgagcgcgtcgcaggacaccgggctcacctccgacgtgcaccccgagatctcttcttcctccggcggcgcccaaaagttcgaccatgagcccgcgctctggggctac

SEQ ID NO: 1421 - protein, 332 aa, Brachypodium distachyon
  Bradi5g12407.1
MDLPPGFRFHPTDEELITHYLAKKVADARFTAFAVSEADLNKCEPWDLPSLARMGEKEWYFFCLKDRKYPTGLRTNRATESGYWKATGKDKDIFRGKGTLVGMKKTLVFYTGRAPKGEKSGWVMHEYRLHGKSTASSKNEWVLCRVFKKSLVGVVASSASASAAVKKGAMGMEDTIGTSSMAAVGTTQLPPLLDMSGSGFVDPAAAHVTCFSNNALEAAGGHGHGHGHFFNSATADDHHHGGLGAASSSSTPFLANYAQYGLVQLLESSSGYRGLDMAAPCKQQQQPAAAACKEMLMSASQDTGLTSDVHPEISSSSGGAQKFDHEPALWGY

SEQ ID NO: 1422 - DNA, 1122 bp, Oryza sativa
  LOC_Os02g36880.1
atgcgattagccaggcagcagcagcaggtggtggtggctgcgacgatggagcatgacgtgcaccaccaccggcagatgatgcagcagcagcagcagcaggagatggacctgccgccgggcttccggttccaccccaccgacgaggagctcatcacgcactacctcctccgcaaggccgccgaccccgccgggttcgccgcgcgcgccgtcggagaggccgacctcaacaagtgcgagccatgggacctgccatcgagggcgacgatgggggagaaggagtggtacttcttctgcgtgaaggaccggaagtacccgacggggctgaggacgaacagggcgacggagtccgggtactggaaggcgacggggaaggaccgggagatcttcagggggaaggccctcgtcggcatgaagaagacgctcgtcttctacaccgggagggccccccgcggcggcaagaccggatgggtcatgcacgagtaccgcatccacggcaagcacgccgccgccaattccaagcaggatcaggagtgggtgctgtgcagggtgttcaagaagagcctcgagctggcgccggcggcggcggcggcggtcggcaggagaggcgcgggcgcggggacggacgttgggccgtcgtcgatgcccatggcggacgacgtcgtcggcctcgccccgtgcgcgctcccgccgctgatggacgtgtctggcggcggcggtggcgccggcacaacctcgctgtcagcgaccgcgggcgcggcggcggcgccgccgccagcgcacgtgacctgcttctccaacgcgctggagggccagttcctggacacaccgtacctcctccccgccgccgatcccgcggatcacctcgccatgtcctccgcctcgccgttcttggaggccctgcagatgcagtacgtccaggacgccgccgccgccggaggagcgggcatggtgcacgagctgctcatgggcggcggctggtattgcaacaagggcgagagggagaggctgagcggcgcctcgcaggacaccggcctcacgtcgtcggaggtgaaccccggcgagatctcgtcgtcgtcgcggcagcaacgcatggatcatcacgacgcgtccctctgggcctat

SEQ ID NO: 1423 - protein, 374 aa, Oryza sativa
  LOC_Os02g36880.1
MRLARQQQQVVVAATMEHDVHHHRQMMQQQQQQEMDLPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRIHGKHAAANSKQDQEWVLCRVFKKSLELAPAAAAAVGRRGAGAGTDVGPSSMPMADDVVGLAPCALPPLMDVSGGGGGAGTTSLSATAGAAAAPPPAHVTCFSNALEGQFLDTPYLLPAADPADHLAMSSASPFLEALQMQYVQDAAAAGGAGMVHELLMGGGWYCNKGERERLSGASQDTGLTSSEVNPGEISSSSRQQRMDHHDASLWAY

SEQ ID NO: 1424 - DNA, 1122 bp, Oryza sativa; identical to SEQ ID NO: 1422
  LOC_Os02g36880.3

SEQ ID NO: 1425 - protein, 374 aa, Oryza sativa; identical to SEQ ID NO: 1423
  LOC_Os02g36880.3

SEQ ID NO: 1426 - DNA, 1122 bp, Oryza sativa; identical to SEQ ID NO: 1422
  LOC_Os02g36880.2

SEQ ID NO: 1427 - protein, 374 aa, Oryza sativa; identical to SEQ ID NO: 1423
  LOC_Os02g36880.2

SEQ ID NO: 1428 - DNA, 1119 bp, Oryza sativa
  LOC_Os02g36880.4
atgcgattagccaggcagcagcagcaggtggtggtggctgcgacgatggagcatgacgtgcaccaccaccggcagatgatgcagcagcagcagcagcaggagatggacctgccgccgggcttccggttccaccccaccgacgaggagctcatcacgcactacctcctccgcaaggccgccgaccccgccgggttcgccgcgcgcgccgtcggagaggccgacctcaacaagtgcgagccatgggacctgccatcgagggcgacgatgggggagaaggagtggtacttcttctgcgtgaaggaccggaagtacccgacggggctgaggacgaacagggcgacggagtccgggtactggaaggcgacggggaaggaccgggagatcttcagggggaaggccctcgtcggcatgaagaagacgctcgtcttctacaccgggagggccccccgcggcggcaagaccggatgggtcatgcacgagtaccgcatccacggcaagcacgccgccgccaattccaaggatcaggagtgggtgctgtgcagggtgttcaagaagagcctcgagctggcgccggcggcggcggcggcggtcggcaggagaggcgcgggcgcggggacggacgttgggccgtcgtcgatgcccatggcggacgacgtcgtcggcctcgccccgtgcgcgctcccgccgctgatggacgtgtctggcggcggcggtggcgccggcacaacctcgctgtcagcgaccgcgggcgcggcggcggcgccgccgccagcgcacgtgacctgcttctccaacgcgctggagggccagttcctggacacaccgtacctcctccccgccgccgatcccgcggatcacctcgccatgtcctccgcctcgccgttcttggaggccctgcagatgcagtacgtccaggacgccgccgccgccggaggagcgggcatggtgcacgagctgctcatgggcggcggctggtattgcaacaagggcgagagggagaggctgagcggcgcctcgcaggacaccggcctcacgtcgtcggaggtgaaccccggcgagatctcgtcgtcgtcgcggcagcaacgcatggatcatcacgacgcgtccctctgggcctat

SEQ ID NO: 1429 - protein, 373 aa, Oryza sativa
  LOC_Os02g36880.4
MRLARQQQQVVVAATMEHDVHHHRQMMQQQQQQEMDLPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRIHGKHAAANSKDQEWVLCRVFKKSLELAPAAAAAVGRRGAGAGTDVGPSSMPMADDVVGLAPCALPPLMDVSGGGGGAGTTSLSATAGAAAAPPPAHVTCFSNALEGQFLDTPYLLPAADPADHLAMSSASPFLEALQMQYVQDAAAAGGAGMVHELLMGGGWYCNKGERERLSGASQDTGLTSSEVNPGEISSSSRQQRMDHHDASLWAY

SEQ ID NO: 1430 - DNA, 1029 bp, Oryza sativa
  LOC_Os04g38720.1
atggagcagcatcagggccaggcaggcatggacttgccccctggcttccgcttccacccgaccgacgaggagctgatcacgcactacctcgccaagaaggtcgccgacgcccgcttcgccgccctcgccgtcgccgaggccgacctcaacaagtgcgagccctgggacctgccatctctggcgaagatgggggagaaggagtggtacttcttctgcctcaaggacaggaagtacccgacggggctgaggacgaacagggcgacggagtccgggtactggaaggccacggggaaggacaaggacatcttcagacggaaggccctcgtcggcatgaagaagacgctcgttttctacacggggcgcgctcccaagggggagaagtctggctgggtcatgcacgagtaccgcctccacggcaagctccacgccgccgccctcggcttcctccacggcaagcccgcgtcgtccaagaacgagtgggtgttgtgcagggtgttcaagaagagcctcgtggaggtgggcgcggcgggagggaagaaggcggccgtggtgacgatggagatggcgaggggagggtcgacgtcgtcgtccgtggcggacgagatcgccatgtcgtccgtcgtcctccctccgctgatggacatgtccggagccggcgccggcgccgtcgacccggcgacgacggcgcacgtgacctgcttctccaacgcgctggagggccagttctttaacccgacggcagtacacgggcacggcggcggcgactcctcgccgttcatggcgagcttcacgcagtacgggcagctgcaccacggcgtgagcctggtgcaactcctggagagctgcaacggctacggcggcctcgtcgacatggcagcgtccggcagccagctgcagccggcggcgtgcggcggcgagcgggagaggcttagcgcgtcgcaggacaccggcctcacctccgacgtgaacccggagatctcgtcatcctccggccaaaaattcgaccacgaggccgcgctatggggctac

SEQ ID NO: 1431 - protein, 343 aa, Oryza sativa
  LOC_Os04g38720.1
MEQHQGQAGMDLPPGFRFHPTDEELITHYLAKKVADARFAALAVAEADLNKCEPWDLPSLAKMGEKEWYFFCLKDRKYPTGLRTNRATESGYWKATGKDKDIFRRKALVGMKKTLVFYTGRAPKGEKSGWVMHEYRLHGKLHAAALGFLHGKPASSKNEWVLCRVFKKSLVEVGAAGGKKAAVVTMEMARGGSTSSSVADEIAMSSVVLPPLMDMSGAGAGAVDPATTAHVTCFSNALEGQFFNPTAVHGHGGGDSSPFMASFTQYGQLHHGVSLVQLLESCNGYGGLVDMAASGSQLQPAACGGERERLSASQDTGLTSDVNPEISSSSGQKFDHEAALWGY

SEQ ID NO: 1432 - DNA, 1005 bp, Setaria italica
  Si010553m
atggagcaggagttgcaccagcccatggagctgcccccgggcttccgtttccaccccaccgacgaggagctcatcacgcactacctcgcccgcaaggtcgccgacgcccgcttcgccgcgttcgccgtcagcgaggccgacctcaacaagtgcgagccctgggacctgccctcgctggcgaagatgggggagaaggagtggtacttcttctgcctcaaggaccgcaagtacccgacggggctgaggacgaacagggccacggaggccgggtactggaaggccacgggcaaggacaaggacatcttcaggggcaaggccctcgtcggctccaagaagacgctcgtcttctacaccgggagggcgcccaagggcgagaagtccggctgggtcatgcacgagtaccgcctccacggcaagctccacggcgccatgcccaagcccgcgtccaagaacgagtgggttctgtgcagggtgttcaagaagagccttatcgtaggcgtaggcgtcccgccagcagccagaaggggcgccatggagatggcggccaagatggacgacatggcagccatctctcacctccctccgctgatggacgtgtccggcgccgccgccaaccccgcggcggcacacgtgacctgcttctccaacgcgctggagggccagtcgttcctcaaccagacggcggcgccgcaagtcgccgccgccgccgccacggaccatctcggcctcgcatcctcctcgccgttcctctccagcttcgcgcagtacggctcgctgcaccacggcggggtgagcctggtgcagctcctggagagcagcgggtacgccggcggcggcggcctaccggacatgcccaagcagcagcagcagccggcgccgccgtgcaagggcggcgagcgggaacggctgagcgcgtcgcaggacaccgggctcacctctgacgttcaccccgagatctcctcctcctccggccaacggttcgaccacgagcagctctggggctac

SEQ ID NO: 1433 - protein, 335 aa, Setaria italica
  Si010553m
MEQELHQPMELPPGFRFHPTDEELITHYLARKVADARFAAFAVSEADLNKCEPWDLPSLAKMGEKEWYFFCLKDRKYPTGLRTNRATEAGYWKATGKDKDIFRGKALVGSKKTLVFYTGRAPKGEKSGWVMHEYRLHGKLHGAMPKPASKNEWVLCRVFKKSLIVGVGVPPAARRGAMEMAAKMDDMAAISHLPPLMDVSGAAANPAAAHVTCFSNALEGQSFLNQTAAPQVAAAAATDHLGLASSSPFLSSFAQYGSLHHGGVSLVQLLESSGYAGGGGLPDMPKQQQQPAPPCKGGERERLSASQDTGLTSDVHPEISSSSGQRFDHEQLWGY

SEQ ID NO: 1434 - protein, 126 aa, Arabidopsis thaliana
  AT5G39610.1 NAM domain
LPPGFRFHPTDEELITHYLKPKVFNTFFSATAIGEVDLNKIEPWDLPWKAKMGEKEWYFFCVRDRKYPTGLRTNRATEAGYWKATGKDKEIFKGKSLVGMKKTLVFYKGRAPKGVKTNWVMHEYRL

SEQ ID NO: 1435 - protein, 126 aa, Arabidopsis thaliana
  AT5G07680.1 NAM domain
LPPGFRFHPTDEELITHYLHKKVLDLGFSAKAIGEVDLNKAEPWELPYKAKIGEKEWYFFCVRDRKYPTGLRTNRATQAGYWKATGKDKEIFRGKSLVGMKKTLVFYRGRAPKGQKTNWVMHEYRL

SEQ ID NO: 1436 - protein, 126 aa, Arabidopsis thaliana
  AT3G29035.1 NAM domain
LPPGFRFHPTDEELITHYLRPKVVNSFFSAIAIGEVDLNKVEPWDLPWKAKLGEKEWYFFCVRDRKYPTGLRTNRATKAGYWKATGKDKEIFKGKSLVGMKKTLVFYKGRAPKGVKTNWVMHEYRL

SEQ ID NO: 1437 - protein, 126 aa, Arabidopsis thaliana
  AT5G61430.1 NAM domain
LPPGFRFHPTDEELITHYLHKKVLDTSFSAKAIGEVDLNKSEPWELPWMAKMGEKEWYFFCVRDRKYPTGLRTNRATEAGYWKATGKDKEIYRGKSLVGMKKTLVFYRGRAPKGQKTNWVMHEYRL

SEQ ID NO: 1438 - protein, 126 aa, Glycine max
  Glyma04g33270.1 NAM domain
LPPGFRFHPTDEELISHYLYRKVTHTNFSARAIGEVDLNRSEPWDLPWKAKMGEKEWYFFCVRDRKYPTGLRTNRATQSGYWKATGKDKEIFRGKSLVGMKKTLVFYKGRAPKGEKTDWVMHEYRL

SEQ ID NO: 1439 - protein, 126 aa, Glycine max
  Glyma06g21020.1 NAM domain
LPPGFRFHPTDEELISHYLYRKVTDTNFSARAIGEVDLNRSEPWDLPWKAKMGEKEWYFFCVRDRKYPTGLRTNRATESGYWKATGKDKEIFRGKSLVGMKKTLVFYKGRAPKGEKTDWVMHEYRL

SEQ ID NO: 1440 - protein, 126 aa, Glycine max
  Glyma17g10970.1 NAM domain
LPPGFRFHPTDEELISHYLYKKVIDTKFCARAIGEVDLNKSEPWDLPWKAKMGEKEWYFFCVRDRKYPTGLRTNRATEAGYWKATGKDKEIFRGKSLVGMKKTLVFYRGRAPKGEKSNWVMHEYRL

SEQ ID NO: 1441 - protein, 126 aa, Glycine max
  Glyma13g05540.1 NAM domain
LPPGFRFHPTDEELITHYLSQKVLDSCFCARAIGEADLNKCEPWDLPWMAKMGEKEWYFFCVRDRKYPTGQRTNRATGVGYWKATGKDREIYKAKALIGMKKTLVFYKGRAPSGEKTSWVMHEYRL

SEQ ID NO: 1442 - protein, 126 aa, Glycine max
  Glyma19g02850.1 NAM domain
LPPGFRFHPTDEELITHYLSQKVLDSCFCARAIGEADLNKCEPWDLPCMAKMGEKEWYFFCVRDRKYPTGQRTNRATGAGYWKATGKDREIYKAKTLIGMKKTLVFYKGRAPSGEKSNWVMHEYRL

SEQ ID NO: 1443 - protein, 126 aa, Glycine max
  Glyma09g37050.1 NAM domain
LPAGFRFHPRDEELINHYLTKKVVDNCFCAVAIAEVDLNKCEPWDLPGLAKMGETEWYFFCVRDRKYPTGLRTNRATDAGYWKATGKDREIIMENALIGMKKTLVFYKGRAPKGEKTNWVMHEYRL

SEQ ID NO: 1444 - protein, 126 aa, Glycine max
  Glyma18g49620.1 NAM domain
LPAGFRFHPTDEELINQYLTKKVVDNCFCAIAIGEVDLNKCEPWDLPGLAKMGETEWYFFCVRDRKFPTGIRTNRATDIGYWKATGKDKEIIMENALIGMKKTLVFYKGRAPKGEKTNWVMHEYRL

SEQ ID NO: 1445 - protein, 124 aa, Glycine max
  Glyma05g00930.1 NAM domain
LPPGFRFHPTDEELISHYLYKKVIDTKFCARAIGEVDLNKSEPWDLPSKMGEKEWYFFCVRDRKYPTGLRTNRATEAGYWKATGKDKEIFRGKSLVGMKKTLVFYRGRAPKGEKSNWVMHEYRL

SEQ ID NO: 1446 - protein, 126 aa, Solanum lycopersicum
  Solyc02g088180.2.1 NAM domain
LPPGFRFHPTDEELITHYLAPKVLDSGFCAIAIGEVDLNKVEPWDLPWKAKMGEKEWYFFCMRDKKYPTGQRTNRATEAGYWKATGKDKEIFKSKTLVGMKKTLVFYKGRAPRGEKTNWVMHEYRL

SEQ ID NO: 1447 - protein, 126 aa, Solanum lycopersicum
  Solyc03g115850.2.1 NAM domain
LPPGFRFHPTDEELITHYLSKKVVDMNFSAIAIGDVDMNKIEPWELPWKAKIGEKEWYFFCVRDKKYPTGLRTNRATAAGYWKATGKDKEIFRGRSLVGMKKTLVFYRGRAPRGEKTNWVTHEYRL

SEQ ID NO: 1448 - protein, 126 aa, Solanum lycopersicum
  Solyc06g069710.2.1 NAM domain
LPPGFRFHPTDEELITHYLSNKVVDTNFVAIAIGDVDLNKVEPWDLPWKAKMGEKEWYFFCVRDKKYPTGLRTNRATAAGYWKATGKDREIFRGKSLVGMKKTLVFYKGRAPKGEKTNWVIHEFRL

SEQ ID NO: 1449 - protein, 126 aa, Populus trichocarpa
  POPTR_0012s01610.1 NAM domain
LPPGFRFHPTDEELISHYLYKKVLDINFSARAIGDVDLNKSEPWELPWKAKMGEKEWYFFCVRDRKYPTGLRTNRATEAGYWKATGKDKEIYRGKSLVGMKKTLVFYKGRAPKGEKTNWVMHEYRL

SEQ ID NO: 1450 - protein, 126 aa, Populus trichocarpa
  POPTR_0015s02170.1 NAM domain
LPPGFRFHPTDEELISHYLYKKVLDITFSAKAIGDVDLNKSEPWELPWKAKMGEKEWYFFCVRDRKYPTGLRTNRATEAGYWKATGKDKEIYRGKFLVGMKKTLVFYKGRAPKGGKTNWVMHEYRL

SEQ ID NO: 1451 - protein, 126 aa, Populus trichocarpa
  POPTR_0017s12210.1 NAM domain
LPPGFRFHPTDEELITHYLSQKVLDNYFCARAIGEVDLNKCEPWDLPWRAKMGEKEWYFFCVIDRKYPTGLRTNRATDAGYWKATGKDKEIYRAKTLVGMKKTLVFYKGRAPKGEKTNWVMHEYRL

SEQ ID NO: 1452 - protein, 126 aa, Vitis vinifera
  GSVIVT01011445001 NAM domain
LPPGFRFHPTDEELITHYLSQKVLNSGFCAVAIGEVDLNKCEPWDLPWKAKMGEKEWYFFCVRDRKYPTGLRTNRATDAGYWKATGKDKEIYKMKTLVGMKKTLVFYKGRAPKGEKTNWVMHEYRL

SEQ ID NO: 1453 - protein, 126 aa, Vitis vinifera
  GSVIVT01007982001 NAM domain
LPPGFRFHPTDEELITHYLSKKVIDSNFSARAIGQVNLNNSEPWELPGKAKMGEKEWYFFCVRDRKYPTGLRTNRATEAGYWKATGKDKEIFRGKSLVGMKKTLVFYAGRAPKGEKTNWVMHEYRL

SEQ ID NO: 1454 - protein, 126 aa, Citrus clementina
  clementine0.9_013688m NAM domain
LPPGFRFHPTDEELITHYLYKKVLDVCFSCRAIGDVDLNKNEPWELPWKAKMGEKEWYFFCMRDRKYPTGLRTNRATVSGYWKATGKDKEIYRGKSLVGMKKTLVFYRGRAPKGEKSSWVMHEYRL

SEQ ID NO: 1455 - protein, 126 aa, Citrus clementina
  clementine0.9_014567m NAM domain
LPPGFRFHPTDEELITHYLTPKVFDGCFSARAIGEVDLNKCEPWDLPRRAKMGEKEWYFFCVRDRKYPTGLRTNRATEAGYWKATGKDKEIYKAKALVGMKKTLVFYKGRAPKGQKTNWVMHEYRL

SEQ ID NO: 1456 - protein, 126 aa, Citrus clementina; identical to SEQ ID NO: 1454
  clementine0.9_012151m NAM domain

SEQ ID NO: 1457 - protein, 126 aa, Eucalyptus grandis
  Eucgr.I01958.1 NAM domain
LPPGFRFHPTDEELITHYLTPKVLDGSFRARAMGEVDLNKCEPWDLPGQAKMGEKEWYFFCVRDRKYPTGMRTNRATEAGYWKATGKDKEIRRMKKVVGMKKTLVFYRGRAPNGQKTNWVMHEFRL

SEQ ID NO: 1458 - protein, 126 aa, Eucalyptus grandis
  Eucgr.B00529.1 NAM domain
LPPGFRFHPTDEELITHYLQKKVGDTGFSAKAIGEVDLNKSEPWDLPWKAKMGEKEWYFFCLRDRKYPTGLRTNRATESGYWKATGKDKEIYRGKSLVGMKKTLVFYRGRAPKGEKTNWVMHEYRL

SEQ ID NO: 1459 - protein, 127 aa, Brachypodium distachyon
  Bradi3g46900.1 NAM domain
LPPGFRFHPTDEELVTHYLARKTADPTGFAARAVGEADLNKCEPWDLPSRATMGEKEWYFFVVKDRKYPTGTRTNRATESGYWKATGKDREILRGKALVGMKKTLVFYTGRAPKGGKTGWVMHEYRL

SEQ ID NO: 1460 - protein, 127 aa, Brachypodium distachyon
  Bradi5g12407.1 NAM domain
LPPGFRFHPTDEELITHYLAKKVADARFTAFAVSEADLNKCEPWDLPSLARMGEKEWYFFCLKDRKYPTGLRTNRATESGYWKATGKDKDIFRGKGTLVGMKKTLVFYTGRAPKGEKSGWVMHEYRL

SEQ ID NO: 1461 - protein, 127 aa, Oryza sativa
  LOC_Os02g36880.1 NAM domain
LPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRI

SEQ ID NO: 1462 - protein, 127 aa, Oryza sativa; identical to SEQ ID NO: 1461
  LOC_Os02g36880.3 NAM domain

SEQ ID NO: 1463 - protein, 127 aa, Oryza sativa; identical to SEQ ID NO: 1461
  LOC_Os02g36880.2 NAM domain

SEQ ID NO: 1464 - protein, 127 aa, Oryza sativa; identical to SEQ ID NO: 1461
  LOC_Os02g36880.4 NAM domain

SEQ ID NO: 1465 - protein, 126 aa, Oryza sativa
  LOC_Os04g38720.1 NAM domain
LPPGFRFHPTDEELITHYLAKKVADARFAALAVAEADLNKCEPWDLPSLAKMGEKEWYFFCLKDRKYPTGLRTNRATESGYWKATGKDKDIFRRKALVGMKKTLVFYTGRAPKGEKSGWVMHEYRL

SEQ ID NO: 1466 - protein, 126 aa, Setaria italica
  Si010553m NAM domain
LPPGFRFHPTDEELITHYLARKVADARFAAFAVSEADLNKCEPWDLPSLAKMGEKEWYFFCLKDRKYPTGLRTNRATEAGYWKATGKDKDIFRGKALVGSKKTLVFYTGRAPKGEKSGWVMHEYRL

SEQ ID NO: 1467 - protein, 127 aa, Arabidopsis thaliana
  consensus sequence containing AtNAC6 clade NAM domain
  misc_feature (3)..(3): Xaa can be Pro or Ala
  misc_feature (10)..(10): Xaa can be any naturally occurring amino acid
  misc_feature (14)..(15): Xaa can be Ile, Leu, Val, or Met
  misc_feature (16)..(16): Xaa can be any naturally occurring amino acid
  misc_feature (17)..(17): Xaa can be His or Gln
  misc_feature (20)..(21): Xaa can be any naturally occurring amino acid
  misc_feature (22)..(22): Xaa can be Lys or Arg
  misc_feature (23)..(25): Xaa can be any naturally occurring amino acid
  misc_feature (26)..(26): Xaa can be Pro or absent
  misc_feature (27)..(28): Xaa can be any naturally occurring amino acid
  misc_feature (30)..(32): Xaa can be any naturally occurring amino acid
  misc_feature (34)..(34): Xaa can be Ile, Leu, Val, or Met
  misc_feature (35)..(35): Xaa can be Gly, Ala, or Ser
  misc_feature (36)..(37): Xaa can be any naturally occurring amino acid
  misc_feature (38)..(38): Xaa can be Asp or Asn
  misc_feature (39)..(39): Xaa can be Ile, Leu, Val, or Met
  misc_feature (42)..(42): Xaa can be any naturally occurring amino acid
  misc_feature (46)..(46): Xaa can be Asp or Glu
  misc_feature (49)..(50): Xaa can be any amino acid or absent
  misc_feature (51)..(51): Xaa can be Ala or Ser
  misc_feature (52)..(52): Xaa can be any naturally occurring amino acid
  misc_feature (53)..(53): Xaa can be Ile, Leu, Val, or Met
  misc_feature (56)..(56): Xaa can be any naturally occurring amino acid
  misc_feature (57)..(57): Xaa can be Asp or Glu
  misc_feature (59)..(59): Xaa can be Tyr or Phe
  misc_feature (62)..(62): Xaa can be any naturally occurring amino acid
  misc_feature (63)..(63): Xaa can be Ile, Leu, Val, or Met
  misc_feature (64)..(64): Xaa can be any naturally occurring amino acid
  misc_feature (66)..(66): Xaa can be Lys or Arg
  misc_feature (68)..(68): Xaa can be Tyr or Phe
  misc_feature (72)..(72): Xaa can be any naturally occurring amino acid
  misc_feature (79)..(80): Xaa can be any naturally occurring amino acid
  misc_feature (90)..(90): Xaa can be Lys or Arg
  misc_feature (91)..(91): Xaa can be Asp or Glu
  misc_feature (93)..(97): Xaa can be any naturally occurring amino acid
  misc_feature (98)..(99): Xaa can be Ile, Leu, Val, or Met
  misc_feature (101)..(101): Xaa can be any naturally occurring amino acid
  misc_feature (109)..(109): Xaa can be any naturally occurring amino acid
  misc_feature (114)..(114): Xaa can be any naturally occurring amino acid
  misc_feature (116)..(116): Xaa can be any naturally occurring amino acid
  misc_feature (118)..(118): Xaa can be Thr or Ser
  misc_feature (119)..(119): Xaa can be any naturally occurring amino acid
  misc_feature (122)..(122): Xaa can be any naturally occurring amino acid
  misc_feature (125)..(125): Xaa can be Tyr or Phe
  misc_feature (127)..(127): Xaa can be Ile, Leu, Val, or Met
LPXGFRFHPXDEEXXXXYLXXXXXXXXXFXXXAXXXXXXNKXEPWXLPXXXXXGEXXWXFFXXXDXKXPTGXRTNRATXXGYWKATGKDXXIXXXXXXXGXKKTLVFYXGRAPXGXKXXWVXHEXRX

SEQ ID NO: 1468 - protein, 8 aa, Arabidopsis thaliana
  AtNAC6 clade small consensus sequence
  misc_feature (1)..(1): Xaa can be Asp or Glu
  misc_feature (2)..(3): Xaa can be any naturally occurring amino acid
  misc_feature (4)..(4): Xaa can be Ile, Leu, Val, or Met
  misc_feature (5)..(5): Xaa can be Cys or Ser
  misc_feature (6)..(6): Xaa can be Lys or Arg
  misc_feature (7)..(7): Xaa can be Ala or Ser
XXXXXXXF

SEQ ID NO: 1469 - protein, 8 aa, Arabidopsis thaliana
  AtNAC6 clade small consensus sequence
  misc_feature (1)..(1): Xaa can be Ile, Leu, Val, or Met
  misc_feature (3)..(3): Xaa can be any naturally occurring amino acid
  misc_feature (5)..(5): Xaa can be any naturally occurring amino acid
  misc_feature (6)..(6): Xaa can be Asp or Glu
  misc_feature (7)..(7): Xaa can be any naturally occurring amino acid
  misc_feature (8)..(8): Xaa can be Ala or Ser
XPXLXXXX

SEQ ID NO: 1470 - DNA, 1014 bp, Arabidopsis thaliana
  AT3G04060.1
atggtggaagaaggcggcgtagttgtgaatcaaggaggagatcaggaggtggtggatttgcctccggggtttcggtttcaccctactgatgaagagataataactcactacctcaaagagaaggtcttcaacatccgatttaccgcggcagcgattggtcaagccgacctcaacaagaacgagccatgggatctaccaaagattgcaaagatgggggagaaggagttttactttttctgccagagggatcggaagtatccgaccgggatgaggacgaaccgtgcgaccgtgtctggttattggaaggcgaccgggaaggacaaggagatctttagaggcaaaggttgtcttgttgggatgaagaaaacacttgttttctatacaggaagagctcctaaaggtgaaaagaccaattgggttatgcatgaatatcgtcttgatggaaaatattcttatcataacctccccaaaaccgcaagggatgaatgggtggtgtgtagggtttttcacaagaacgctcctagtactacaatcactactacaaaacaactctcaaggattgattctcttgataacattgatcatctcttagacttctcatctctccctcctctcatagatccgggtttcttgggtcaacccggcccaagcttctccggtgcccgtcaacaacacgatctcaaacctgttctccaccatcctacaaccgcaccagtcgacaacacttaccttcctacccaagctctcaatttcccttaccactcggtccataattccggatctgatttcggctacggggcaggttcaggcaataataacaaaggtatgatcaagttggagcattctcttgtgagtgtgtctcaagaaaccggtttgagttccgatgtgaacacaaccgcaacgccagagatatcttcttatccaatgatgatgaatccggcaatgatggatggtagcaagtcagcgtgtgatggtcttgatgacttgatcttctgggaagatttatatactagc

SEQ ID NO: 1471 - protein, 338 aa, Arabidopsis thaliana
  AT3G04060.1
MVEEGGVVVNQGGDQEVVDLPPGFRFHPTDEEIITHYLKEKVFNIRFTAAAIGQADLNKNEPWDLPKIAKMGEKEFYFFCQRDRKYPTGMRTNRATVSGYWKATGKDKEIFRGKGCLVGMKKTLVFYTGRAPKGEKTNWVMHEYRLDGKYSYHNLPKTARDEWVVCRVFHKNAPSTTITTTKQLSRIDSLDNIDHLLDFSSLPPLIDPGFLGQPGPSFSGARQQHDLKPVLHHPTTAPVDNTYLPTQALNFPYHSVHNSGSDFGYGAGSGNNNKGMIKLEHSLVSVSQETGLSSDVNTTATPEISSYPMMMNPAMMDGSKSACDGLDDLIFWEDLYTS

SEQ ID NO: 1472 - DNA, 1005 bp, Arabidopsis thaliana
  AT5G18270.1
atggcggttgtggttgaagaaggtgtggtgttgaatcatggaggtgaagagcttgtggatttgccacctggtttcaggtttcatccaacagacgaagagatcataacatgttaccttaaggagaaggttttaaacagccgattcacggctgtggccatgggagaagctgatctcaacaagtgtgagccttgggatttgccaaagagggcaaagatgggggagaaagagttctacttcttctgtcaaagggacaggaagtatccgactgggatgaggacgaaccgtgcgacggagtcaggatactggaaagccaccgggaaggataaggagatcttcaaaggcaaaggttgtctcgttgggatgaagaaaacacttgtgttttatagaggaagagctccaaaaggtgaaaagactaattgggtcatgcatgaatatcgtcttgaaggcaaatattcgtattacaatctcccaaaatctgcaagggacgaatgggtcgtgtgtagggtttttcacaagaacaatccttctaccacaacccaaccaatgacgagaatacccgttgaagatttcacaaggatggattctctagagaacattgatcatctcctagacttctcatctcttcctcctctcatagacccgagtttcatgagtcaaaccgaacaaccaaacttcaaacccatcaaccctccaacttacgatatctcatcaccaatccaaccccatcatttcaattcttaccaatcaatctttaaccaccaggtttttggttctgcttcgggctctacgtacaacaacaacaacgagatgatcaagatggagcaatcacttgttagtgtatctcaagaaacatgcctaagctcagatgtgaacgcgaacatgactacaaccacggaggtatcttcgggtcctgtaatgaaacaagaaatggggatgatgggaatggtgaatggtagcaagtcgtatgaagatctatgtgacttgaggggggacttgtgggacttc

SEQ ID NO: 1473 - protein, 335 aa, Arabidopsis thaliana
  AT5G18270.1
MAVVVEEGVVLNHGGEELVDLPPGFRFHPTDEEIITCYLKEKVLNSRFTAVAMGEADLNKCEPWDLPKRAKMGEKEFYFFCQRDRKYPTGMRTNRATESGYWKATGKDKEIFKGKGCLVGMKKTLVFYRGRAPKGEKTNWVMHEYRLEGKYSYYNLPKSARDEWVVCRVFHKNNPSTTTQPMTRIPVEDFTRMDSLENIDHLLDFSSLPPLIDPSFMSQTEQPNFKPINPPTYDISSPIQPHHFNSYQSIFNHQVFGSASGSTYNNNNEMIKMEQSLVSVSQETCLSSDVNANMTTTTEVSSGPVMKQEMGMMGMVNGSKSYEDLCDLRGDLWDF

SEQ ID NO: 1474 - DNA, 1230 bp, Glycine max
  Glyma02g07760.1
atgatggaagagccggttgtggttaacaaaggagatgatcatgatcatgatcacgagcctttggatttgcctccaggtttcaggttccaccccacagatgaagagatcatcacttgttacctcacagagaaagtcctcaatagaaccttcagtgcaactgctattggagaagctgatttcaacaagtgtgagccttgggacttgcccaagaaagcaaagatgggggagaaagattggtacttcttttgccaaagggataggaagtatccaacaggcatgagaaccaatagagcaacccaatctgggtattggaaggccactggcaaagacaaagagattttcaaagggaagaacaaccttgttgggatgaagaagacccttgttttctatagaggaagagctcctaagggtgagaagtcaaattgggttatgcatgaattcagattggatggcaaattcgcatgttacaaccttcccaaggcttcaaaggatgaatgggttgtgtgcaaggttttccacaagggcaacaccactactacagatgttgttaacaaaagggcactcccaataattaacccttgccttttgagaatgaactcatcaattggagaagatctatttgatttctcttctctcccacctctcgtggatcctctctttgaccaaacctcaaacaagcacattgacaatgatttcaagggtactaataacacgccttcatcttcatcagctaaaccaccatcaagtggctactatcttcccaacttcatcaacaacaacaacaatcagcacatgctaatgatgatgaagccagaagaacacaaaatgtatgagattcccaccaacaactatgcctccaccagccaagtgaatttcactactactaataacccaataatgggaattagcacaggcaataacaatacccttctttctcagcctcaaattcgaacccaaaattcaacctcagtacccttcaacatgttccaagattattataattatatgaaccaaggaaaacaatgcaagatggagcaattctcaaacactaagaaccagcctgtggtcagtgcctctcaagacacgtgcctcagcaatgacacttcctcggtggtttctaagcaagacaacaacataggaaggaacaaggcattgtacgaggataattttgaagctccttcatcagttgctactaccctctcagatttggaatgcctgtgggatgattac

SEQ ID NO: 1475 - protein, 410 aa, Glycine max
  Glyma02g07760.1
MMEEPVVVNKGDDHDHDHEPLDLPPGFRFHPTDEEIITCYLTEKVLNRTFSATAIGEADFNKCEPWDLPKKAKMGEKDWYFFCQRDRKYPTGMRTNRATQSGYWKATGKDKEIFKGKNNLVGMKKTLVFYRGRAPKGEKSNWVMHEFRLDGKFACYNLPKASKDEWVVCKVFHKGNTTTTDVVNKRALPIINPCLLRMNSSIGEDLFDFSSLPPLVDPLFDQTSNKHIDNDFKGTNNTPSSSSAKPPSSGYYLPNFINNNNNQHMLMMMKPEEHKMYEIPTNNYASTSQVNFTTTNNPIMGISTGNNNTLLSQPQIRTQNSTSVPFNMFQDYYNYMNQGKQCKMEQFSNTKNQPVVSASQDTCLSNDTSSVVSKQDNNIGRNKALYEDNFEAPSSVATTLSDLECLWDDY

SEQ ID NO: 1476 - DNA, 1230 bp, Glycine max
  Glyma16g26810.1
atgatggaagagccggttgtggttaacaaaggagattatgatcatgatcatgatcagcctttggatttacctccaggtttcaggttccaccccacagatgaagagatcatcacttgttacctcacagagaaagtcctcaatagagccttcagtgcaactgctattggagaagctgatttcaacaagtgtgagccttgggatttgcccaagaaagcaaagatgggggagaaagattggtacttcttttgccaaagggataggaagtacccaacaggcatgcgaaccaatagagcaacccaatctgggtattggaaggccactggcaaagataaagagattttcaaagggaagaacaaccttgttggcatgaagaagacccttgttttctatagaggaagagctccaaagggtgagaagacaaattgggttatgcatgaattcagattggatggcaaattcgcatgttacaaccttcccaaggctgcaaaggatgaatgggttgtgtgcaaggttttccacaagagcagcactactactacagatgttaacaaaagggtactcccaataattaaccctggccttctgagaatgaactcaagtaatggagaagatctattatttgatttctcttctctcccacctctcgtggatcctctctttgaccaaacctcaaacaagcacattgacaatgatttcaagggtactaataacacaccttcatcttcatcagctaaactaccatcatcaagtggctactatcttcccaacttcaacaacaacaacaatcagcaaatgcttatgatgaagccagaagaacacaaaatatatgagattcccatcaacaactatgcctccaccagtcaagtggatttcactacaactaataacccaatgggaattagcacaagcaataataatatccttctttctcagcctcaaattcgaacccaaaattcaacctcagtacccttcaacatgttccaagattgttataatcatacgcaccaaggaaaacagtgcaagatggagcaattctccattgacagtactaagaaacagcccgtggtcagtgcctctcaagacacgtgcctcagcaatgacacttcctcggtggtttcaaagcaagacaataacatgggaaggaacaaggcattgtacgaggataattttgaaggtccttcatcagttgctactaccctctcagatttggaatgcctgtgggatgattac

SEQ ID NO: 1477 - protein, 410 aa, Glycine max
  Glyma16g26810.1
MMEEPVVVNKGDYDHDHDQPLDLPPGFRFHPTDEEIITCYLTEKVLNRAFSATAIGEADFNKCEPWDLPKKAKMGEKDWYFFCQRDRKYPTGMRTNRATQSGYWKATGKDKEIFKGKNNLVGMKKTLVFYRGRAPKGEKTNWVMHEFRLDGKFACYNLPKAAKDEWVVCKVFHKSSTTTTDVNKRVLPIINPGLLRMNSSNGEDLLFDFSSLPPLVDPLFDQTSNKHIDNDFKGTNNTPSSSSAKLPSSSGYYLPNFNNNNNQQMLMMKPEEHKIYEIPINNYASTSQVDFTTTNNPMGISTSNNNILLSQPQIRTQNSTSVPFNMFQDCYNHTHQGKQCKMEQFSIDSTKKQPVVSASQDTCLSNDTSSVVSKQDNNMGRNKALYEDNFEGPSSVATTLSDLECLWDDY

SEQ ID NO: 1478 - DNA, 1221 bp, Glycine max
  Glyma16g04720.1
atggaagagcctattgtggtgaacaaaggtgaggagcctttagatttgcctccaggtttcaggttccaccctaccgatgaagagataatcacttattatctcactgagaaggtgaagaatagcattttcagtgcaattgctattggagaggctgatttgaacaagtgtgaaccttgggatttaccaaagaaagccaagataggggagaaagagtggtacttcttctgtcaaaaggataggaagtacccaactgggatgagaaccaatagagcaacagaatctgggtactggaaggccacaggaaaagataaggagatttacaaagggaaagggaaccttgtggggatgaagaagaccctcgtgttctataaagggagagctccaaagggtgagaagagcaattgggtcatgcatgaattcagattggaaggcaaatttgctagttacaatcttcctaaggcagcaaaggatgaatgggttgtctcaagggtttttcacaagaacacagatgtcaaaaagtcctcaattcctggccttttgaggataaactctattggggatgatcttcttgattattcttcactcccatctctcatggatcctccttatggcaacaacaccaacaccaccaacaacaacaacaacaatgctaacccactttcatcaactaaattatcacaatcagagggctattatcttcccagtttctccatcaacaacaaccaccaccagcttctcatcaagccagaagaccaccacaaccacagaatctatgaatttcccacaattaacttcacctccaaccaaaccaatctcagcagcaacaacgttaacccaatggggaacaacaacacactctcatcacagcccttaaacatgttctcagctgattactatgtacaccaaaacaggatcaaaagctccatcatgccaagtgttgcaggctcaggttttgttagcgacaacaataaccatgatgaagctatcctaagagcatttgcagccaagaacaacgagcacatacagtgcaagatggagcaattttcttctaaccactcacaagacacgggcttgagcaacgacagaaacacaactgacacatcctcggtggtttcgatgggaagaaataataataatagggcactgtacgaggatcttgaaggcccttcttcagttgcacctctctcagatttggaatgcctgcagtgggatgatgactac

SEQ ID NO: 1479 - protein, 407 aa, Glycine max
  Glyma16g04720.1
MEEPIVVNKGEEPLDLPPGFRFHPTDEEIITYYLTEKVKNSIFSAIAIGEADLNKCEPWDLPKKAKIGEKEWYFFCQKDRKYPTGMRTNRATESGYWKATGKDKEIYKGKGNLVGMKKTLVFYKGRAPKGEKSNWVMHEFRLEGKFASYNLPKAAKDEWVVSRVFHKNTDVKKSSIPGLLRINSIGDDLLDYSSLPSLMDPPYGNNTNTTNNNNNNANPLSSTKLSQSEGYYLPSFSINNNHHQLLIKPEDHHNHRIYEFPTINFTSNQTNLSSNNVNPMGNNNTLSSQPLNMFSADYYVHQNRIKSSIMPSVAGSGFVSDNNNHDEAILRAFAAKNNEHIQCKMEQFSSNHSQDTGLSNDRNTTDTSSVVSMGRNNNNRALYEDLEGPSSVAPLSDLECLQWDDDY

SEQ ID NO: 1480 - DNA, 1167 bp, Populus trichocarpa
  POPTR_0013s05110.1
atggaagaagctgttgtggttaacaaaggagatgatcagattcatctgccagcgggttttcggttccatccaacagatgaagagatcataagtcattaccttacagagaaagtgatgaaaagtggtttctgtgcaattgctattggtgaagttgatctcaataagtgtgaaccatgggatctgccgaagaaagcaaagatgggagagaatgaatggtatttcttttgccaaagagataggaaatatccaactggtatgagaactaaccgtgcgactgaatctgggtactggaaggctacaggaaaagataaggaaattcacaaggaaaagaattgccttgttggaatgaagaagacccttgttttctacagagggagagctcctaaaggagagaaaaccaattgggttatgcatgaatataggcttgaaggcaaattctcctactacagcctccccaaagtagcaagggatgaatgggttgtttgtaggattttccataagagcacaggcatgaagaaaacttcaattcatgatctcctaagaatgaactcttttggagatgatttcttggattgctcctcactcccacctctcatggacccccctaattacactagcagcttcagcgatgccgataacaatgagttcaaggcaatgatgacttcaagatcctcagatggaaattacttctccaatactagcatgctcaacaacaatcaaggctttgttcaacctccaaataccaactaccaaacaccaaactcaagttttcaccttcaaactccagcttcaaaccctctttacacctttcaaaccaatcccaatatgcctgtttacttgcagcaaggaaaaagtaccaattcatttccaaactttcaaaactctacgtttggtaacaatggccaaacccttctgagagcattagctgcaggaaataattatggagaagcatctgatcaattggggaaacagtgcaaggttgaacagttctcatctaaccaatctatggtcagcctttcacaggacactggacttagcacagacgtgaacaccacaactgagatatcctccgtcgtatcgaagcaagaaataggaagccacaatgagttttacgaaagtcttgaggatccattagctggtcccattgcagattacatgtgggattac

SEQ ID NO: 1481 - protein, 389 aa, Populus trichocarpa
  POPTR_0013s05110.1
MEEAVVVNKGDDQIHLPAGFRFHPTDEEIISHYLTEKVMKSGFCAIAIGEVDLNKCEPWDLPKKAKMGENEWYFFCQRDRKYPTGMRTNRATESGYWKATGKDKEIHKEKNCLVGMKKTLVFYRGRAPKGEKTNWVMHEYRLEGKFSYYSLPKVARDEWVVCRIFHKSTGMKKTSIHDLLRMNSFGDDFLDCSSLPPLMDPPNYTSSFSDADNNEFKAMMTSRSSDGNYFSNTSMLNNNQGFVQPPNTNYQTPNSSFHLQTPASNPLYTFQTNPNMPVYLQQGKSTNSFPNFQNSTFGNNGQTLLRALAAGNNYGEASDQLGKQCKVEQFSSNQSMVSLSQDTGLSTDVNTTTEISSVVSKQEIGSHNEFYESLEDPLAGPIADYMWDY

SEQ ID NO: 1482 - DNA, 1188 bp, Populus trichocarpa
  POPTR_0019s04710.1
atgacaatggaggaagctattgtggtgaacaaaggagatgatctgattgatttgccaccaggttttcggttccaccctacagatgaagagataataactcattatcttacagagaaggtgatgaatagtagcttctgtgcaagtgctattggtgaagttgatctcaataaggttgagccatgggatttgccaaagaaagcaaagatgggagagaaggaatggtatttcttttgccaaagagacaggaaatatccaactggtatgagaaccaatcgtgctacagaatcagggtactggaaggctactgggaaagacaaggaaatttacaagggaaaacatagccttgttgggatgaagaagactcttgttttctacaaagggagagctcccaaaggagagaaatccaattgggttatgcatgaatacagacttgaaggcaaattctcatactatagcctccccaaggttgcaagggacgaatgggttgtttgcaggattttccacaagagtacaggcatcaagaaaacctcaattcatgacctcctaagggtgaactctttcggagatgatttcttggattactcctccctgccacctttcatggatccccttaattacaatagcaggccaagcaccagcagcttcagtggtggcgataacaatgagttcaaggaaatggcaacaagatcatcagatggaaattatttctccaatacaagcatgctcaacaacaatcaaaactttgctcaacctccaaataccaactaccaagcaccaaactccagttttcaccctcaaattccagcctcaaatcctctttacacctttcaaaccagtcccaatatgcctggctacttgcaccaaggaaagagttcttctaattcattccaaaactttcaaaactctatcttcagtgacaatgaacatacccttctaagatcattagctagaaacagttatagagaagcatctggattggagaaacagtgcaaggttgagcgcttctcatctaatcaatctatggtcagcctttcacaggacactggacttagcacagacgtgaacaccacagctgagatatcatctgtggtttcaaagcaagaaatagggagccatgataaggtttttgaagatcttgagggtccatcagctggccccattgcagatttggattgcttgtgggattat

SEQ ID NO: 1483 - protein, 396 aa, Populus trichocarpa
  POPTR_0019s04710.1
MTMEEAIVVNKGDDLIDLPPGFRFHPTDEEIITHYLTEKVMNSSFCASAIGEVDLNKVEPWDLPKKAKMGEKEWYFFCQRDRKYPTGMRTNRATESGYWKATGKDKEIYKGKHSLVGMKKTLVFYKGRAPKGEKSNWVMHEYRLEGKFSYYSLPKVARDEWVVCRIFHKSTGIKKTSIHDLLRVNSFGDDFLDYSSLPPFMDPLNYNSRPSTSSFSGGDNNEFKEMATRSSDGNYFSNTSMLNNNQNFAQPPNTNYQAPNSSFHPQIPASNPLYTFQTSPNMPGYLHQGKSSSNSFQNFQNSIFSDNEHTLLRSLARNSYREASGLEKQCKVERFSSNQSMVSLSQDTGLSTDVNTTAEISSVVSKQEIGSHDKVFEDLEGPSAGPIADLDCLWDY

SEQ ID NO: 1484 - DNA, 1101 bp, Populus trichocarpa
  POPTR_0019s04710.2
atgacaatggaggaagctattgtggtgaacaaaggagatgatctgattgatttgccaccaggttttcggttccaccctacagatgaagagataataactcattatcttacagagaagatgggagagaaggaatggtatttcttttgccaaagagacaggaaatatccaactggtatgagaaccaatcgtgctacagaatcagggtactggaaggctactgggaaagacaaggaaatttacaagggaaaacatagccttgttgggatgaagaagactcttgttttctacaaagggagagctcccaaaggagagaaatccaattgggttatgcatgaatacagacttgaaggcaaattctcatactatagcctccccaaggttgcaagggacgaatgggttgtttgcaggattttccacaagagtacaggcatcaagaaaacctcaattcatgacctcctaagggtgaactctttcggagatgatttcttggattactcctccctgccacctttcatggatccccttaattacaatagcaggccaagcaccagcagcttcagtggtggcgataacaatgagttcaaggaaatggcaacaagatcatcagatggaaattatttctccaatacaagcatgctcaacaacaatcaaaactttgctcaacctccaaataccaactaccaagcaccaaactccagttttcaccctcaaattccagcctcaaatcctctttacacctttcaaaccagtcccaatatgcctggctacttgcaccaaggaaagagttcttctaattcattccaaaactttcaaaactctatcttcagtgacaatgaacatacccttctaagatcattagctagaaacagttatagagaagcatctggattggagaaacagtgcaaggttgagcgcttctcatctaatcaatctatggtcagcctttcacaggacactggacttagcacagacgtgaacaccacagctgagatatcatctgtggtttcaaagcaagaaatagggagccatgataaggtttttgaagatcttgagggtccatcagctggccccattgcagatttggattgcttgtgggattat

SEQ ID NO: 1485 - protein, 367 aa, Populus trichocarpa
  POPTR_0019s04710.2
MTMEEAIVVNKGDDLIDLPPGFRFHPTDEEIITHYLTEKMGEKEWYFFCQRDRKYPTGMRTNRATESGYWKATGKDKEIYKGKHSLVGMKKTLVFYKGRAPKGEKSNWVMHEYRLEGKFSYYSLPKVARDEWVVCRIFHKSTGIKKTSIHDLLRVNSFGDDFLDYSSLPPFMDPLNYNSRPSTSSFSGGDNNEFKEMATRSSDGNYFSNTSMLNNNQNFAQPPNTNYQAPNSSFHPQIPASNPLYTFQTSPNMPGYLHQGKSSSNSFQNFQNSIFSDNEHTLLRSLARNSYREASGLEKQCKVERFSSNQSMVSLSQDTGLSTDVNTTAEISSVVSKQEIGSHDKVFEDLEGPSAGPIADLDCLWDY

SEQ ID NO: 1486 - DNA, 1170 bp, Vitis vinifera
  GSVIVT01033374001
atggatttgcccccaggttttagattccaccctacagatgaagagatcatatcttattatctcacggagagggtgatgaatagtagcttcagtgcaagagctattggagaagttgaccttaacaagtgtgaaccctgggatttacctaagaaagcaaagatgggagagaaggaatggtatttcttttgccagagagataggaagtatcctacaggcatgagaacgaatcgagctaccgaatctggatactggaaggccactggaaaggataaagagatttacaaggggaagggttgtcttgttgggatgaagaagacccttgttttctaccgagggagagcccccaaaggagagaaaagcaattgggtcatgcacgaatacagactggaaggcaaattctcatattacaacctccccaaagccgcaaaggatgaatgggtcgtctgtagggtattccacaagagcgcggggatcaaacgaagtcttattcctgcgccgataaggatgaactcttttggggatgatctcttggactgttcttctctaccacctcttattgaccctccttattccaaccccaacaaaaatgattcctgctttacaaatggtgaagatgaattcaagggatcatcaaccagattttcagatggaaaccaccactacccttacttctcccccaccataaacggtcatcaactgcaaaagcaacaagatcagaagagctttcttctatcccccaataacgtgcacaccacctccaactaccaagccaccctaagcaaccctacaccaaactccattttctacccccaagtttctccctcgaatcctcttttccccttccaagcatccccaactcctagttattcacactggcagatgggtagttcatttccaagctttccgggctctggcttcaaaggtagtgatccgaccagtaccgtaagagcccagacatctggcgtacagaggcaatgcaaggtggagcagttctcatccaaccagtctatggtcagcctctcgcaggacaccggactcagcactgacatgaacacggagatatcctctgtgctttcaaagcatcaagacacaggaaacaacaggtcttacgaagatcttcaaggtccatcggtcggccaaatcggagatttggattatttactcgactac

SEQ ID NO: 1487 - protein, 390 aa, Vitis vinifera
  GSVIVT01033374001
MDLPPGFRFHPTDEEIISYYLTERVMNSSFSARAIGEVDLNKCEPWDLPKKAKMGEKEWYFFCQRDRKYPTGMRTNRATESGYWKATGKDKEIYKGKGCLVGMKKTLVFYRGRAPKGEKSNWVMHEYRLEGKFSYYNLPKAAKDEWVVCRVFHKSAGIKRSLIPAPIRMNSFGDDLLDCSSLPPLIDPPYSNPNKNDSCFTNGEDEFKGSSTRFSDGNHHYPYFSPTINGHQLQKQQDQKSFLLSPNNVHTTSNYQATLSNPTPNSIFYPQVSPSNPLFPFQASPTPSYSHWQMGSSFPSFPGSGFKGSDPTSTVRAQTSGVQRQCKVEQFSSNQSMVSLSQDTGLSTDMNTEISSVLSKHQDTGNNRSYEDLQGPSVGQIGDLDYLLDY

SEQ ID NO: 1488 - DNA, 1161 bp, Citrus clementina
  clementine0.9_012645m
atggaggaagccgtagttgatcaacacaatcatcgtcaaggagtgatagatttgccacccgggtttcgcttccacccaacggacgaagagatcataactcattatctcacggaaaaggtcatgaacacaagcttctctgcatgcgctatcggtgaagttgatttgaacaagtctgagccatgggatttgcccagtaaagcgaagatgggggagaaggaattttatttcttttgtcagagagaccggaagtatccaacgggtatgagaacaaaccgagcaacggaggccggatactggaaggcgaccggcaaagataaagagatttacaaaggaaataaaggcggcgtcggtggtggcggccttgttggtatgaagaagactcttgttttttacaaaggaagagctcctaaaggtgaaaaaaccaattgggtcatgcacgaatatagacttgaaggcaaattctcttactacaatctccccaaggctgctaaggatgaatgggtggtttgtagggtttttcacaagaacattggaggaggaattaaaaagattccaattccagggctgccaatgaactcatcttttggtgatgacttttttgctaattatgcttcgcttccaccactaatggatcctcctggttcttcgagctttggaaatggtgaccatcaaaatgagttcaaacccatgaacacagcatccacttcatcaagatcttacaatatccccgcagacaatcaaaatttccttcagcctcatcaaattccaatccaaaatcaaatcttctcctatcaccaaaacaataataacccgaatccaggctacttgcaccagggaacaatacggagtagcacgggtgcaatctcgagcttgatgggtgccggctttgagggaaatggtgatggtcaggccattttaagagcgttagcaagcacatctcaccatcatcagcagcataatttggagagcagcagccagtgcaaagttgagcagttttcatctaaccaatccatgatcagccgctcacaagacaccggcctcagcactgacatgaacactactaccgaaatttcatctgttgtttcgaagcaagataacaagtcttatgatcaggatctcgatgctacatctattgctgaattggatagcttttgggactac

SEQ ID NO: 1489 - protein, 387 aa, Citrus clementina
  clementine0.9_012645m
MEEAVVDQHNHRQGVIDLPPGFRFHPTDEEIITHYLTEKVMNTSFSACAIGEVDLNKSEPWDLPSKAKMGEKEFYFFCQRDRKYPTGMRTNRATEAGYWKATGKDKEIYKGNKGGVGGGGLVGMKKTLVFYKGRAPKGEKTNWVMHEYRLEGKFSYYNLPKAAKDEWVVCRVFHKNIGGGIKKIPIPGLPMNSSFGDDFFANYASLPPLMDPPGSSSFGNGDHQNEFKPMNTASTSSRSYNIPADNQNFLQPHQIPIQNQIFSYHQNNNNPNPGYLHQGTIRSSTGAISSLMGAGFEGNGDGQAILRALASTSHHHQQHNLESSSQCKVEQFSSNQSMISRSQDTGLSTDMNTTTEISSVVSKQDNKSYDQDLDATSIAELDSFWDY

SEQ ID NO: 1490 - DNA, 1230 bp, Eucalyptus grandis
  Eucgr.A02074.1
atggaagaagaaggtatggtggtgaaccaagggagggagcatcaggagctgatggacttgcctccgggcttcagattccaccccacggacgaggagatcataacccactacctcactcccaaggtcctgaacagctccttctccgccagtgcagtctcggaagtagatctcaacaagtgcgagccctgggacttgccaacgaaagccaagatgggcgagaaagagtggtacttcttttgccagaaggataggaagtacccgacagggaccaggaccaatagagccacggagtctgggtattggaaggccacaggcaaagataaggagatttacagagggagaggcaggctcgtgggaatgaagaaaacccttgttttctacatgggtcgagcccccaagggagagaagactaactgggtcatgcatgagtacagattggagggcaaattggcttactacaatctctccagggccgccaaggatgaatgggtggtgagtagggttttccacaagagcacgggcgtcaagaaagatccgtctccaggcctgctcacaagaatcaattcttatgtcgatgactttctggatatgtcttcacccccgccgcctctcatagacgccccttcttcaagcagaccgagctcgagcttcaccgatggggaaaatgaactgaagggcgtgatcaattcaggcccaagagcgctggatgggaacggcagttacttttattttccggcagattcgactgataaccagaaccaagtactactccaggagcaaggagatcgcatgaattattgtcatgtgatgaacccaagtattgatgccagtcattgccctccacaattatcgaatcatcctcctctctttccctctcacgggtctacaaatcctgaggagtacttgcaccaaggaccaagcgacgtgggatcaagctttggtggcacgggtttcagctgtgggagcaccgatcctgctcttctaagagcaataagggcaaattttggggcatcgaacccccaaaataacaatcagtgcaaagtggagcagttttcatccaatcattctatggttagtctatctcaagacaccgggctcagcacggatgttaacaatgagatatcttctgtaccgatctccaagcaagaggtgggcagctgtgacgcatttgaagacctcgagggtttatcatcagtaggcccgattcaagatttcggtttttgggactac

SEQ ID NO: 1491 - protein, 410 aa, Eucalyptus grandis
  Eucgr.A02074.1
MEEEGMVVNQGREHQELMDLPPGFRFHPTDEEIITHYLTPKVLNSSFSASAVSEVDLNKCEPWDLPTKAKMGEKEWYFFCQKDRKYPTGTRTNRATESGYWKATGKDKEIYRGRGRLVGMKKTLVFYMGRAPKGEKTNWVMHEYRLEGKLAYYNLSRAAKDEWVVSRVFHKSTGVKKDPSPGLLTRINSYVDDFLDMSSPPPPLIDAPSSSRPSSSFTDGENELKGVINSGPRALDGNGSYFYFPADSTDNQNQVLLQEQGDRMNYCHVMNPSIDASHCPPQLSNHPPLFPSHGSTNPEEYLHQGPSDVGSSFGGTGFSCGSTDPALLRAIRANFGASNPQNNNQCKVEQFSSNHSMVSLSQDTGLSTDVNNEISSVPISKQEVGSCDAFEDLEGLSSVGPIQDFGFWDY

SEQ ID NO: 1492 - DNA, 1095 bp, Eucalyptus grandis
  Eucgr.K01472.1
atggaagacgaaatcgtagaactgcctccgggcttcaggttccaccccacggacgaagagatcatcactcactacctcaccaagaaagtcctcaaccccaatttcaactcctgcgctattggtgaggctgatctgaacaagtccgaaccctgggatttgcctaagaaagcgcatatgggggagaaggagcggtacttcttcaaccagaaggaccggaagtacccgacggggatgaggacgaaccgggcgacggagtccggctactggaaggccacgggcaaggacaaggagattttccgagggaagagcaacctggtcgggatgaagaagaccctcgtcttctacaagggaagggcccctaagggggagaagactaactgggtcatgcacgagtaccgcctcgagggcaaattctcttactacaatctcccaaaggtctcaaaggatgagtgggtggtgtcgaggattttccacaagagcactgggatcaagaagaacgagagcggtctgatttcgggcccgtttccgatcgatccttccggtgatgacgagctgccgaatccttctccttctccttcgcttcctcctctcatggacgactcttatttcgcgaggccaatctcaagcttcccgaaaagtgagaatgatttcccagacatgacaagcgcgtctgcaccaagatcggctgaaggaaattacggggacgaaatgaatgggttccacaggttcaacccaagcaataccaactaccaaacagacccaagtagctcggccttcagctccatgttctccgggcaattgtcgttccccatctcgccgtatgatggcatagataatccggacttcttcttgggattcggctatggaggcagcgacaatactcaggcgatcatccgaggggtggcggcgacccaacacgagacgcggggcctggagcagacgctgatcaagggagagcagttcgcgatgtcgaacaacaagtccgtggtcagccactcgcaggacaccgggctgagcactgacgcaaacgccgagacatcctcctccgccatctccaagcatgaagccgggaacttctccgactacctctgggaa

SEQ ID NO: 1493 - protein, 365 aa, Eucalyptus grandis
  Eucgr.K01472.1
MEDEIVELPPGFRFHPTDEEIITHYLTKKVLNPNFNSCAIGEADLNKSEPWDLPKKAHMGEKERYFFNQKDRKYPTGMRTNRATESGYWKATGKDKEIFRGKSNLVGMKKTLVFYKGRAPKGEKTNWVMHEYRLEGKFSYYNLPKVSKDEWVVSRIFHKSTGIKKNESGLISGPFPIDPSGDDELPNPSPSPSLPPLMDDSYFARPISSFPKSENDFPDMTSASAPRSAEGNYGDEMNGFHRFNPSNTNYQTDPSSSAFSSMFSGQLSFPISPYDGIDNPDFFLGFGYGGSDNTQAIIRGVAATQHETRGLEQTLIKGEQFAMSNNKSVVSHSQDTGLSTDANAETSSSAISKHEAGNFSDYLWE

SEQ ID NO: 1494 - DNA, 1074 bp, Brachypodium distachyon
  Bradi1g63630.1
atgtctgaggtgtcggtgataaaccaggcggaggtggaggactcggcggccgggctcaacctgccgccgggcttccggttccaccccaccgacgaggagatcatctcgcactacctcacccccaaggcactcgacgaccgcttctcatccggcgtcatcggcgaggtcgacttgaacaagtgcgagccatggcacctcccaggccaggcgaagatgggggagaaggagtggtacttcttctgccacaaggaccggaagtacccgacgggcacgagaacgaaccgcgccaccgagagcggctactggaaggccacaggcaaggataaggagatcttccgcgggaggggcgtcctcgttgggatgaagaagaccctcgtcttctaccgtggccgcgccccccgcgggcagaagaccggctgggtcatgcacgagttccgcctcgagggcaagctcccccacccgctcccgcgctccgccaaggacgagtgggccgtgtccaaggtgttcaacaaagagctgctgacgccggcgagcaacgggacgacaatggcggcgggggaggcggagatggagcgagtcaactcgttcggcttcatcagcgacttccttgactccgcggagctgccgccgctcatggacccttcgttcggcgccgacgtcgacgaagtgatcgacttcaagggccccgcgtccacctccggctacgccgcgggagacgccgccggtgcccattcgggcatgggctaccagctgcaggtcaagatggaagaccccgtccaactgcagtatcagcatcagcagcagcagcacatgatgtactcgagcccgtacttctcgctgccggcggtgaactcgggcgacatgtcgccggcgatccggaggtactgcaaggcggagcaggtgtccgggcagacttcggtgctcagcccgtccagggagaccgggctcagcaccgatcccaacgccgcaggctgcacggagatctcctcggcggtgacgcctgctgcgtcccagcagttcctggaccacctcgacgagtaccccgcgctgaacctggccgacatttggaagtac

SEQ ID NO: 1495 - protein, 358 aa, Brachypodium distachyon
  Bradi1g63630.1
MSEVSVINQAEVEDSAAGLNLPPGFRFHPTDEEIISHYLTPKALDDRFSSGVIGEVDLNKCEPWHLPGQAKMGEKEWYFFCHKDRKYPTGTRTNRATESGYWKATGKDKEIFRGRGVLVGMKKTLVFYRGRAPRGQKTGWVMHEFRLEGKLPHPLPRSAKDEWAVSKVFNKELLTPASNGTTMAAGEAEMERVNSFGFISDFLDSAELPPLMDPSFGADVDEVIDFKGPASTSGYAAGDAAGAHSGMGYQLQVKMEDPVQLQYQHQQQQHMMYSSPYFSLPAVNSGDMSPAIRRYCKAEQVSGQTSVLSPSRETGLSTDPNAAGCTEISSAVTPAASQQFLDHLDEYPALNLADIWKY

SEQ ID NO: 1496 - DNA, 1299 bp, Zea mays
  GRMZM2G031001_T01
atgccgccccagcccctccctccgctcctccagtccaagcccccttgccttctttctcagctcacctctctctttcacgcacgcctctctctctctctctctctctctctctctctctctctctctctctctctctctctctctctctctctctctctccttatctgtcctgaggcagccatttcctcttccgatcgtggagaggcttggagtggaaggaggctgctggttttcggcacggcggagatgtctgaggtgtcggtgataaaccaggcggaggtggaggacgcgggcgccgggcagctgatggacctgccgccgggcttccgcttccaccccaccgacgaggagatcatctcgcactacctcacccacaaggccctcgaccaccgcttcgtctccggcgtcatcggcgaggtcgacctcaacaggatcgagccatgggacctgccaggcagggccaagatgggggagaaggagtggtacttcttctgccacaaggatcgcaagtacccgacgggcacgcggaccaaccgcgccacggagaccggctactggaaggccaccggcaaggacaaggagatcttcaggggccgcggcgtcctcgtgggcatgaagaagacgctcgtcttctaccgcggccgcgcgccgcgcggggagaagaccggatgggtcatgcacgagttccgcctcgagggcaggcttccccagccgctcccgcgctccgccaaggacgagtgggccgtgtgcaaggtgttcaacaaggagctgcaggcggcgaggagcgagccattattggcggcggccggcgcggcggagctcgagcgcgtgggctcgctgggcttcctcaacgagctcctcgactccgcggagctgccggccctcgtcggagccgacgtggacgaggtgatcgacttcaagggccccgcccccgcgtccgttccggacgcgagctacctcccggtcaagatggaggagcacgcgctgctgcagatgcagcagtgccagtaccagccgccgcccccgatgttctacccgagccagtacttctctcttccggcgatgaactccggccacctccccccggcgatccggaggtactgcaaggcggagcagcaggtggtctcggcgcagacggcgtcggtgatcagcccgtcccgcgagaccgggctcagcaccgaccccaacgcggcgggcggctacgcggagatctcgtcggcggcgaccccgtcgtcgtcgcaccagttcctgcccgagctcgacgacccggccctcaacctcgccgacctctggaagtac

SEQ ID NO: 1497 - protein, 433 aa, Zea mays
  GRMZM2G031001_T01
MPPQPLPPLLQSKPPCLLSQLTSLFHARLSLSLSLSLSLSLSLSLSLSLSLSLLICPEAAISSSDRGEAWSGRRLLVFGTAEMSEVSVINQAEVEDAGAGQLMDLPPGFRFHPTDEEIISHYLTHKALDHRFVSGVIGEVDLNRIEPWDLPGRAKMGEKEWYFFCHKDRKYPTGTRTNRATETGYWKATGKDKEIFRGRGVLVGMKKTLVFYRGRAPRGEKTGWVMHEFRLEGRLPQPLPRSAKDEWAVCKVFNKELQAARSEPLLAAAGAAELERVGSLGFLNELLDSAELPALVGADVDEVIDFKGPAPASVPDASYLPVKMEEHALLQMQQCQYQPPPPMFYPSQYFSLPAMNSGHLPPAIRRYCKAEQQVVSAQTASVISPSRETGLSTDPNAAGGYAEISSAATPSSSHQFLPELDDPALNLADLWKY

SEQ ID NO: 1498 - DNA, 1044 bp, Zea mays
  GRMZM2G159500_T02
atgtctgaggtgtcggtgataaaccaggcggaggtggaggatgcgggtgccgggcagctggacctgccgccggggttccgcttccaccccaccgacgaggagatcatctcgcactacctcgcccataaggccctcaaccaccgcttcgtctccggtgtcatcggcgaggtcgacctcaacaagtgcgagccatgggacctgccaggcagggccaagatgggggagaaggagtggtacttcttctgccacaaggatcgcaagtacccgacgggcacgcggaccaaccgcgccacggagaccggctactggaaggccaccggcaaggacaaggagatcttcaggggccgcggcgtcctcgtgggcatgaagaagacgctcgtcttctaccgcggccgcgcgccgcgcggggagaagaccggctgggtcatgcacgagttccgcctcgagggcaagcttcccgagcggctcccgcgctccgccaaggacgagtgggccgtgtgcaaggtgttcaacaaggagctggcggcgaggaccgagccaataatggcggcggccggcgcgggcgagctcgagcgcgtcggctcgctgggcttcctcagcgagctcctcgactccgccgagctgccggccctcatcggcgccgacgtcgacgaggtgatcgacttcaacggccccgcgtccacctccggcgcgccgggcacgagccacagccacctcccggtcaagatggaggagcacgcgctgctgcacatgcagtaccagccgccgccgcccccgacgtcctactactcgagccagtacttctctctgccggcgatgaactccggcgacgtccttcccccggcgatccggaggtactgcaaggcggagcagcaggtggtgtcggggcagacggcggcgtcggaggtcagcccgtcccgcgagaccgggctgagcgccgaccccaacgcggagatctcgtcggcggtgaccccgtcgtcgtcgcaccagttcctgcccgagttcgacgacccggtcctgaacctcgcggacctctggaagtac

SEQ ID NO: 1499 - protein, 348 aa, Zea mays
  GRMZM2G159500_T02
MSEVSVINQAEVEDAGAGQLDLPPGFRFHPTDEEIISHYLAHKALNHRFVSGVIGEVDLNKCEPWDLPGRAKMGEKEWYFFCHKDRKYPTGTRTNRATETGYWKATGKDKEIFRGRGVLVGMKKTLVFYRGRAPRGEKTGWVMHEFRLEGKLPERLPRSAKDEWAVCKVFNKELAARTEPIMAAAGAGELERVGSLGFLSELLDSAELPALIGADVDEVIDFNGPASTSGAPGTSHSHLPVKMEEHALLHMQYQPPPPPTSYYSSQYFSLPAMNSGDVLPPAIRRYCKAEQQVVSGQTAASEVSPSRETGLSADPNAEISSAVTPSSSHQFLPEFDDPVLNLADLWKY

SEQ ID NO: 1500 - DNA, 954 bp, Zea mays
  GRMZM2G181605_T01
atggcatcgtcgtcgcggctggatctcccgccggggttccgcttccaccccaccgacgaggaggtggtgtcgcactacctgacccacaaggcgctggacagccgcttctcctgcgtcgtcatcgccgacgccgacctcaacaagatcgagccgtgggatctcccaagcaaggctaagatgggcgagaaggagtggttcttcttctgccacaaggaccgcaagtacccgacggggatgcgcaccaaccgcgccaccgccagcgggtactggaaggccacggggaaggacaaggagatcttccgcggcagtagcagtagtccccgccgcgtgctcgtcggcatgaagaagacgctcgtcttctacacgggccgcgcgccgcgcggaggcaagacgccgtgggtcatgcacgagtaccgcctcgagggcagcctgccgcacaacctccaccgcggggccaaggacgaatgggctgtgtgtaaggtgatcaacaaagacttggcgggcaaggctgggcaacaacaaatggcgccgccgccgcacgccgtgtccgtgggcatggagcgcagcgactcgctggccttcctcgacgacctggtgctcgacaacgccgacgacctgcccccgctcgtcgactcgacaacgtacgccgccggctccctcttcgccgcggcggggacgaccacgacgacgaacgacgacagcggcgggtaccaacaagccaccaaggcggagccgcagccgcagctgcccgcgccgagcaacagcccgtaccagcaccagcagcaggccatacggaggcactgcaaggcggaggcgccggcgccggcgatggtgctgagcccgtcgcgcgagacgccgggcgcggacatgttccagctccagcatgtggacgagctgctccagctggacggcggcttcatggaggactactacaacatgaacatgtggaaggtc

SEQ ID NO: 1501 - protein, 318 aa, Zea mays
  GRMZM2G181605_T01
MASSSRLDLPPGFRFHPTDEEVVSHYLTHKALDSRFSCVVIADADLNKIEPWDLPSKAKMGEKEWFFFCHKDRKYPTGMRTNRATASGYWKATGKDKEIFRGSSSSPRRVLVGMKKTLVFYTGRAPRGGKTPWVMHEYRLEGSLPHNLHRGAKDEWAVCKVINKDLAGKAGQQQMAPPPHAVSVGMERSDSLAFLDDLVLDNADDLPPLVDSTTYAAGSLFAAAGTTTTTNDDSGGYQQATKAEPQPQLPAPSNSPYQHQQQAIRRHCKAEAPAPAMVLSPSRETPGADMFQLQHVDELLQLDGGFMEDYYNMNMWKV

SEQ ID NO: 1502 - DNA, 1074 bp, Oryza sativa
  LOC_Os03g21030.1
atgtctgaggtgtccgttatggccgaggtggaggagacggcggcggcggcgccgctggacctgccgccggggttcaggttccaccccaccgacgaggagatcgtctcgcactacctcacccccaaggccctcaaccaccgcttctcctccggcgtcatcggcgacgtcgacctcaacaagtgcgagccatggcacctcccagccatggcgaagatgggggagaaggagtggtacttcttctgccacaaggaccgcaagtacccgaccgggacgaggacgaaccgggcgacggagagcggctactggaaggccaccggcaaggacaaggagatcttccgcgggaggggcatcctcgtcggcatgaagaagacgctcgtcttctacctcggccgcgcgccccgtggcgagaagaccggctgggtgatgcacgagttccgcctcgagggcaagctccccagccagctcccgcgctccgccaaggaccagtgggcggtgtgcaaggtgttcaacaaggagttggcgctggcggcgaagaacgggccaatggcggtgaccgaagcgaccgccgacgacgcggggatcgagcgggtcggctcgttcagcttcctcagcgacttcatcgaccccgccgagctgccgccgctgatggacccttccttcgtcgccgacatcgacggggtggacgacgccaaggtgtccgcgtcgacctccgggcaggccgcgatcgccgccggcttccatgtcgcgtcgcaggtcatgagctaccagcaggtcaagatggaagagccgttgccgctgccgtacctgcaccagcagccgccgcggatgctgcactcgggtcagtacttctcgctcccggcggtgcaccccggcgacctgacgccgtcggcgatccggaggtactgcaaggcggagcaggtctcggggcagacgtcggcgctcagcgcctcgcgcgacaccgggctcagcaccgaccccaacgccgccggctgcgcggagatctcgtcggcgccgacgtcccagccgttcccggagttcgacgacgggattctgggcctcgacgacttctggaac

SEQ ID NO: 1503 - protein, 358 aa, Oryza sativa
  LOC_Os03g21030.1
MSEVSVMAEVEETAAAAPLDLPPGFRFHPTDEEIVSHYLTPKALNHRFSSGVIGDVDLNKCEPWHLPAMAKMGEKEWYFFCHKDRKYPTGTRTNRATESGYWKATGKDKEIFRGRGILVGMKKTLVFYLGRAPRGEKTGWVMHEFRLEGKLPSQLPRSAKDQWAVCKVFNKELALAAKNGPMAVTEATADDAGIERVGSFSFLSDFIDPAELPPLMDPSFVADIDGVDDAKVSASTSGQAAIAAGFHVASQVMSYQQVKMEEPLPLPYLHQQPPRMLHSGQYFSLPAVHPGDLTPSAIRRYCKAEQVSGQTSALSASRDTGLSTDPNAAGCAEISSAPTSQPFPEFDDGILGLDDFWN

SEQ ID NO: 1504 - DNA, 1362 bp, Setaria italica
  Si035639m
atggttatcgggatttctcgccgttttctggaaagcaaccgggaggaaggaggaggatatgaatatctgatgcccgggggtagcggcgcgttgaattcttctcgctgccatgtggggacggacagatatgcctgcccatgtctactcccccactcccactttgctttcttccccaacccacctctctctttcacacacgcctctacctctcctctctctttccctgtgaggcagccatctccgcttcctctcgtcgaggcttggagcggaagagagaaagggaggctgctgctggtgttgttcggtgcggcggagatgtctgaggtgtccgtgataaaccaggcggaggtggaggacgccgggcagctcgacctgccgccggggttccgcttccaccccaccgacgaggagatcatcacgcactacctcacccacaaggccctcgaccaccgcttcgtctccggcgtcatcggcgaggtcgacctcaacaagtgcgagccgtgggatctcccaggccgggccaagatgggggagaaggagtggttcttcttctgccacaaggatcgcaagtacccgacggggacgcggaccaaccgcgccacggagaccggctactggaaggccaccggcaaggacaaggagatcttcaggggccgcggcatcctcgtcggcatgaagaagaccctcgtcttctaccgcggccgcgccccgcgcggggagaagaccggctgggtcatgcacgagttccgcctcgagggcaagcttccccacgcgctgccgcgctccgccaaggacgagtgggccgtgtgcaaggtgttcaacaaggagctggcggcgaggacggagcccgcaatggcggcggccggcgcggagctcgagcgcatcggctcgttgggcttcatcagcgagctcctcgacagcgccgagctgcctcccctcatggacccttccttcggcggcgaggtggacgaggtgatcgacttcaagggcgtcgcgtccacctcgggccacgccgccgcggcgccgggcactagctacctgccggtcaagatggaggagcacgcgccgctgcagtaccagcagcagccgccgatgttctactccggccagtacttctcgctgccggcggtgaactccggcgacctgaccccggccatccggaggtactgcaaggcggagcaggtggcctccgggcagacgacgtcggtgctcagcccgtcccgcgagaccgggctcagcaccgaccgcaacgccggcggcgggtgcgcggagatctcgtcggcggtgacgccgtcggcgtcgcaccagttcctgcacgatctcgacgacccgctcctctacgtcgccgacttctggaagcac

SEQ ID NO: 1505 - protein, 454 aa, Setaria italica
  Si035639m
MVIGISRRFLESNREEGGGYEYLMPGGSGALNSSRCHVGTDRYACPCLLPHSHFAFFPNPPLSFTHASTSPLSFPVRQPSPLPLVEAWSGREKGRLLLVLFGAAEMSEVSVINQAEVEDAGQLDLPPGFRFHPTDEEIITHYLTHKALDHRFVSGVIGEVDLNKCEPWDLPGRAKMGEKEWFFFCHKDRKYPTGTRTNRATETGYWKATGKDKEIFRGRGILVGMKKTLVFYRGRAPRGEKTGWVMHEFRLEGKLPHALPRSAKDEWAVCKVFNKELAARTEPAMAAAGAELERIGSLGFISELLDSAELPPLMDPSFGGEVDEVIDFKGVASTSGHAAAAPGTSYLPVKMEEHAPLQYQQQPPMFYSGQYFSLPAVNSGDLTPAIRRYCKAEQVASGQTTSVLSPSRETGLSTDRNAGGGCAEISSAVTPSASHQFLHDLDDPLLYVADFWKH

SEQ ID NO: 1506 - DNA, 963 bp, Arabidopsis thaliana
  WRKY17 (AT2G24570.1 or G866)
atgaccgttgatattatgcgtttacctaagatggaagatcaaacggctatacaagaagctgcatcacaaggcttaaaaagcatggaacacttgattcgtgtcctctctaaccgtcccgaagaacgtaacgttgattgctctgagatcactgatttcacagtttctaagttcaagaaagttatctctcttcttaaccgttccggtcacgcccggtttagacgtggtccggttcattcccctccttcctcctccgttcctccaccggtgaaagtgacaactccggctcccactcagatctctgctccagcaccggttagcttcgttcaggcaaatcaacaaagcgtgacgttagatttcactagaccgagcgtttttggcgctaaaaccaagagctcggaggttgttgagtttgctaaagagagctttagcgtatcttctaactcttctttcatgtcttctgcgatcaccggtgatggaagtgtctctaaaggctcttcgatctttcttgctccggctccagcggtgccagtgacttcctccgggaaaccgccgctttctggtcttccttacaggaagagatgctttgaacatgaccactctgaaggcttttccggcaagatctctggctccggcaacggcaagtgccattgcaagaaaagccgaaaaaatcggatgaagagaaccgtgagagtaccggcggtaagtgcaaagatcgccgatataccaccagacgaatattcatggagaaagtatggacaaaaaccgatcaaaggctcaccacatccacggggttattacaagtgtagtacatttagaggatgtccagcgaggaaacacgtggaaagagctttggatgattcaacgatgttgattgtgacgtacgaaggagagcaccgtcatcaccagtccacgatgcaggagcatgtaactcctagcgtgagtggtttggtgtttggttcggct

SEQ ID NO: 1507 - protein, 321 aa, Arabidopsis thaliana
  WRKY17 (AT2G24570.1 or G866) polypeptide
MTVDIMRLPKMEDQTAIQEAASQGLKSMEHLIRVLSNRPEERNVDCSEITDFTVSKFKKVISLLNRSGHARFRRGPVHSPPSSSVPPPVKVTTPAPTQISAPAPVSFVQANQQSVTLDFTRPSVFGAKTKSSEVVEFAKESFSVSSNSSFMSSAITGDGSVSKGSSIFLAPAPAVPVTSSGKPPLSGLPYRKRCFEHDHSEGFSGKISGSGNGKCHCKKSRKNRMKRTVRVPAVSAKIADIPPDEYSWRKYGQKPIKGSPHPRGYYKCSTFRGCPARKHVERALDDSTMLIVTYEGEHRHHQSTMQEHVTPSVSGLVFGSA

SEQ ID NO: 1508 - DNA, 975 bp, Arabidopsis thaliana
  AT4G31550.1
atggccgtcgatctaatgcgtttccctaagatagatgatcaaacggctattcaggaagctgcatcgcaaggtttacaaagtatggaacatctgatccgtgtcctctctaaccgtcccgaacaacaacacaacgttgactgctccgagatcactgacttcaccgtttctaaattcaaaaccgtcatttctctccttaaccgtactggtcacgctcggttcagacgcggaccggttcactccacttcctctgccgcatctcagaaactacagagtcagatcgttaaaaatactcaacctgaggctccgatagtgagaacaactacgaatcaccctcaaatcgttcctccaccgtctagtgtaacactcgatttctctaaaccaagcatcttcggcaccaaagctaagagcgccgagctggaattctccaaagaaaacttcagtgtttctttaaactcctcattcatgtcgtcggcgataaccggagacggcagcgtctccaatggaaaaatcttccttgcttctgctccgttgcagcctgttaactcttccggaaaaccaccgttggctggtcatccttacagaaagagatgtctcgagcatgagcactcagagagtttctccggaaaagtctccggctccgcctacggaaagtgccattgcaagaaaagcaggaaaaatcggatgaagagaaccgtgagagtaccggcgataagtgcaaagatcgccgatattccaccggacgaatattcgtggaggaagtacggacaaaaaccgatcaagggctcaccacacccacgtggttactacaagtgcagtacattcagaggatgtccagcgaggaaacacgtggaacgagcattagatgatccagcgatgcttattgtgacatacgaaggagagcaccgtcataaccaatccgcgatgcaggagaatatttcttcttcaggcattaatgatttagtgtttgcctcggct

SEQ ID NO: 1509 - protein, 325 aa, Arabidopsis thaliana
  AT4G31550.1 polypeptide
MAVDLMRFPKIDDQTAIQEAASQGLQSMEHLIRVLSNRPEQQHNVDCSEITDFTVSKFKTVISLLNRTGHARFRRGPVHSTSSAASQKLQSQIVKNTQPEAPIVRTTTNHPQIVPPPSSVTLDFSKPSIFGTKAKSAELEFSKENFSVSLNSSFMSSAITGDGSVSNGKIFLASAPLQPVNSSGKPPLAGHPYRKRCLEHEHSESFSGKVSGSAYGKCHCKKSRKNRMKRTVRVPAISAKIADIPPDEYSWRKYGQKPIKGSPHPRGYYKCSTFRGCPARKHVERALDDPAMLIVTYEGEHRHNQSAMQENISSSGINDLVFASA

SEQ ID NO: 1510 - DNA, 948 bp, Glycine max
  Glyma14g17730.1
atggcattggaactcatggggttcccaaaactagacgaacaaaaggccattcaagaggccgcatcagaaggcctcaaaggcatggagcacttgatccgaactctctcccaccaaccctttcacttaaacaccgaactcaccgatgttactgtttccaagtttaagaaactcatttcgctcctaaaccgaaccggccatgcccgattcagacgggccccggttcagtactcatctccacccgcacctgttcacaacgctaacacttccacctcatcaattcaactccctcctccgccgcaaaaccctaatattcccgcgccggtgcagtttccttctcctgcgccggtggccgttcaccacgcgccggtgacgctcgatttcacgaagccgcacaacgcgcttctgagctccaacgcgaaatctgttgagctcgagttctcgaaggagaccttcagcgtttcatcgaactcgtccttcatgtcctccgcgatcaccggcgatggcagcgtctccaacgggaagatcttcctggcgccgccggcgacctccgcccgaaaacctccagcgttcaagaagcggtgccacgaacaccgcgaacactccggcgacgtctccggcaacagcaagtgccactgcgttaagcgaaggaaaaatagggtgaagaacacagtgagagtgccggcgattagttcaaaaatcgccgatattccacccgacgagtactcgtggagaaagtacggtcagaaaccgatcaagggttccccatacccaaggggttactacaagtgcagcacggtgagagggtgcccagcgaggaagcacgtggagcgcgcaccagacgatccggcgatgctgatagtgacgtacgagggggagcacaggcacgccgttcaggccgcgatgcaggagaacgcagccggggtggtggggttggtgttcgagtcaacg

SEQ ID NO: 1511 - protein, 316 aa, Glycine max
  Glyma14g17730.1 polypeptide
MALELMGFPKLDEQKAIQEAASEGLKGMEHLIRTLSHQPFHLNTELTDVTVSKFKKLISLLNRTGHARFRRAPVQYSSPPAPVHNANTSTSSIQLPPPPQNPNIPAPVQFPSPAPVAVHHAPVTLDFTKPHNALLSSNAKSVELEFSKETFSVSSNSSFMSSAITGDGSVSNGKIFLAPPATSARKPPAFKKRCHEHREHSGDVSGNSKCHCVKRRKNRVKNTVRVPAISSKIADIPPDEYSWRKYGQKPIKGSPYPRGYYKCSTVRGCPARKHVERAPDDPAMLIVTYEGEHRHAVQAAMQENAAGVVGLVFEST

SEQ ID NO: 1512 - DNA, 948 bp, Glycine max
  Glyma17g29190.1
atggctgtggaactcatggggttcccaaaactagacgaacaaaaggccattcaagaagccgcatcagaaggcctcaagggcatgaaacacctgatccgaaccctttccaaccaaccctctcacttaaacaccgaacttaccgacgttaccgtttcaaagttcaagaaacttatttcactcttaaatcgaaccggccacgcccggttcagacgcgccccggttcagtactcatctccacacgcacccgttcacaacactaacgcttccacctcatcaattcaactccctcctccgccgcaaaaccctaatattcccgcgctggcgcagtttcctactccggcgccggtggccgtgcaccacacgccggtgacgctcgatttcacgaagccgcacaacgcgcttctgagctccaacgccaaatccgtcgagctcgagttctcgaaggaaaccttcagcgtttcctctaactcctctttcatgtcctccgcgatcaccggcgacggcagcgtctccaatgggaagattttcctcgcgccaccggcgacctccgccggaaaacgtccggcgttcaagaagcggtgccacgaacaccgcgaacactccgacgatgtctccggcaacagcaagtgccactgcgttaagcgaaggaaaaatagggtgaagagcactgtgagagtgccggcgattagttcaaaagtcgccgatattccaccggacgagtactcgtggaggaagtacggtcagaaaccgatcaagggttccccatacccaaggggttactacaagtgcagcacgattagagggtgcccagcgaggaagcacgtggagcgcgcaccagacgatcctgcaatgctgatagtgacgtacgagggggagcacaggcacgcggttcaggctgcgatgcaggagaacgcagccggggtggtggggttggtgttcgagtcaacg

SEQ ID NO: 1513 - protein, 316 aa, Glycine max
  Glyma17g29190.1 polypeptide
MAVELMGFPKLDEQKAIQEAASEGLKGMKHLIRTLSNQPSHLNTELTDVTVSKFKKLISLLNRTGHARFRRAPVQYSSPHAPVHNTNASTSSIQLPPPPQNPNIPALAQFPTPAPVAVHHTPVTLDFTKPHNALLSSNAKSVELEFSKETFSVSSNSSFMSSAITGDGSVSNGKIFLAPPATSAGKRPAFKKRCHEHREHSDDVSGNSKCHCVKRRKNRVKSTVRVPAISSKVADIPPDEYSWRKYGQKPIKGSPYPRGYYKCSTIRGCPARKHVERAPDDPAMLIVTYEGEHRHAVQAAMQENAAGVVGLVFEST

SEQ ID NO: 1514 - DNA, 900 bp, Glycine max
  Glyma06g08120.1
atgacagtggagcttatggggttccccaaaatggaggaacagaaggcaattcaagaagctgcctccgaaggcctcaaggccatggaacacctcctccgtctcctatcctatcaaccctctcacctccacgctcaccacaccgacgccaccgtttccaacttcaaaaaactcatctccttactcagccgccgcaccggccacgcccgtttccgtcgcgcacctctcccttccccgccaccggctaacccggtcaccctccaccaacctccctccaccttcgtcccttcgcactcccagtctctaaccctcgatttcacaaaacctagcattttcgcctccaacgccaaatccatggacctccaattctctaaagaaaccttcagcgtctcctccaactcctccttcatgtcctccgccatcaccggcgacgccagtgtctcttacggcaaactaggatcctccctcttcctcactcctccgccagtctcagccggaaaacctcctctctcctccgctccgatcaagaagaggtgtcacgaccaccgcgaacactccgacgagatctccgggaaactctccggctccagcaagtgccactgcactaagagaaggaagaatcgagtgaagaaaacggtaagagttccggtgatcagttcgaagatcgccgatattccgccggacgagtactcgtggaggaagtacgggcagaagccgatcaagggatcgccgtacccgagggggtattacaagtgcagtagcgttagagggtgtccggcgaggaaacacgtggagcgtgctccggacgatccgacgatgttgattgtgacatatgaaggggagcaccggcactcgatgcaggagaacatttccgggggagtgggtttgggattcgagtcaacg

SEQ ID NO: 1515 - protein, 300 aa, Glycine max
  Glyma06g08120.1 polypeptide
MTVELMGFPKMEEQKAIQEAASEGLKAMEHLLRLLSYQPSHLHAHHTDATVSNFKKLISLLSRRTGHARFRRAPLPSPPPANPVTLHQPPSTFVPSHSQSLTLDFTKPSIFASNAKSMDLQFSKETFSVSSNSSFMSSAITGDASVSYGKLGSSLFLTPPPVSAGKPPLSSAPIKKRCHDHREHSDEISGKLSGSSKCHCTKRRKNRVKKTVRVPVISSKIADIPPDEYSWRKYGQKPIKGSPYPRGYYKCSSVRGCPARKHVERAPDDPTMLIVTYEGEHRHSMQENISGGVGLGFEST

SEQ ID NO: 1516 - DNA, 1014 bp, Solanum lycopersicum
  Solyc12g096350.1.1
atggctgttttatcaaaaatgaatgaaagttttgctgttgaagaagcagcttccgccggtttgaaatcaatggagaatttaatccgattggtttctcatgaaccggttcaggctgattgccgtgaaatggctgattttacggtttcgaagttcaaaaaggtgatttcaattttggaccggaccggtcatgctcggttccggcgaggaccggttcaggctcaggctccggctccggttcaggttagagctccggttcgtggtccggtttatcctgattcgtttacttcgttgtctcttgctccgtcgttaagctttgctacggcgaaggagagacttgctccgtcgttaagctttgcttcggcgaaggagagaccggtggtgcaggtgcagacggcgttgacgcttgacttttcgaagctgaatgttaaccgtccgatcgggaattcaagtgcttttactgcttttactgtgaaatctaaggaggttttaatggcggatccgacgccgacgaactcgtcgtcgtttatgtcgacgattaccggcgaagcaactgtatctaatggtaagcaagtttcttcttctatgttgttgcttccgccacaggctgtgaattttccgaccaccggaaaacgttgccgcgagcatgaacaatctgatgctatctccggcagcaaatccaccggctccggcaagtgtcactgcaaaaagaggaaagctaaggatcggaaagtgattaggattccggcgataagtacgagggtggctgatataccgggagacgagttttcatggaggaaatacgggcaaaagccgatcaagggttcaaaatacccaaggggttattacaagtgtagcagcttacgtggatgtccagcaaggaaacacgtggagcgcgcgatggacgatccaacgatgctgattgtgacttatgaagatgaacattgtcataatccagttgctgcgatgcatgggaacagttctcaaatggtgaattttgggttaatggaaaagaag

SEQ ID NO: 1517 - protein, 338 aa, Solanum lycopersicum
  Solyc12g096350.1.1 polypeptide
MAVLSKMNESFAVEEAASAGLKSMENLIRLVSHEPVQADCREMADFTVSKFKKVISILDRTGHARFRRGPVQAQAPAPVQVRAPVRGPVYPDSFTSLSLAPSLSFATAKERLAPSLSFASAKERPVVQVQTALTLDFSKLNVNRPIGNSSAFTAFTVKSKEVLMADPTPTNSSSFMSTITGEATVSNGKQVSSSMLLLPPQAVNFPTTGKRCREHEQSDAISGSKSTGSGKCHCKKRKAKDRKVIRIPAISTRVADIPGDEFSWRKYGQKPIKGSKYPRGYYKCSSLRGCPARKHVERAMDDPTMLIVTYEDEHCHNPVAAMHGNSSQMVNFGLMEKK

SEQ ID NO: 1518 - DNA, 1026 bp, Citrus clementina
  clementine0.9_014855m
atggcggtggagctgatgggatttccaaaaaggatgatggaagatcagacggcgatacaagaagctgcaacgcaagggatcaaaagcatggagcacctgatccgtctcatgtctcatcaccaatcctcgaatcacgttgactgctcggacctcaccgatctcaccgtctctaagttcaaaaaagtcatttccctgctcaaccgaaccggtcacgcccggttcaggcgcgggccggttcactcttcgccttcatcttcatctgcatctgcgccagccgccgccgccgcctcaggcaactctccacacacacagaccttaactcttactccgcctgctcctacgatggctgtcgctccctctacggcgagttacgtccagtcacagccgcacagtctgactcttgattttacaaaacctagtttgtttagcggaaacgtcaagagcactgagctcgagttttccaaagacagcttctgtgtgtcgtcgaactcgtccttcatgtcctctgctatcaccggagacggcagcgtttcgaacgggaagcaaggaggatcttcgatcttcttggcgccacaagctcctgctgtttccgctggaaagccgccgctcgcggctcagccttacaagaagaggtgtcaagatcataaagatcattccgatgatctttccggcaagttctccggctccacctctggcaacaacaagtgtcactgctctaagagaaggaaaaaccgagtaaagaaaactattagagtgccggcgattagttcaaaaatagccgatattccaccggacgagtattcttggaggaagtatggtcaaaagccgatcaagggctcaccatacccacgcggctattacaagtgcagtacaatgagagggtgcccagccaggaaacacgtggagagggcaccagacgatccaacgatgctgattgtgacgtacgaaggagagcaccggcattcgcaggccgcgatgcaggagaacgcggcccctgctggagtgggtttggttttcgagtcaacg

SEQ ID NO: 1519 - protein, 342 aa, Citrus clementina
  clementine0.9_014855m polypeptide
MAVELMGFPKRMMEDQTAIQEAATQGIKSMEHLIRLMSHHQSSNHVDCSDLTDLTVSKFKKVISLLNRTGHARFRRGPVHSSPSSSSASAPAAAAASGNSPHTQTLTLTPPAPTMAVAPSTASYVQSQPHSLTLDFTKPSLFSGNVKSTELEFSKDSFCVSSNSSFMSSAITGDGSVSNGKQGGSSIFLAPQAPAVSAGKPPLAAQPYKKRCQDHKDHSDDLSGKFSGSTSGNNKCHCSKRRKNRVKKTIRVPAISSKIADIPPDEYSWRKYGQKPIKGSPYPRGYYKCSTMRGCPARKHVERAPDDPTMLIVTYEGEHRHSQAAMQENAAPAGVGLVFEST

SEQ ID NO: 1520 - DNA, 1029 bp, Eucalyptus grandis
  Eucgr.C04011.1
atggcgatcgagctgcatcttggcttctccaagatggaggatcacacggcgatacaggaggccgcgtctcaggggctgaagaccatggagcacctgatcggcgtcctctcccgccagaacctccaccaccccggcgccgtcgactgcaccgacctcaccgaccggaccgtctccaagttcaggaaggtcatctccctcctggaccgcaccggccacgcccgcttccggcgggccccgctcccctcctcctcctcttcctcctccaagtctgcccccgtcgcttcccctgtccccccggcggttcagtctcggagccagcctctagcgccgacgcccatccaggccccgacgagctcgcagccgtctccggccagcttcctccacgcgcagcccaagcagagcttgaccctcgacttcacccggccgagcatcctgggccccaactccaaaggcgtttccgagatcgagttcgcgaaggacagcttcagcgtgtcgtccaactcttccttcatgtcttcggcgatcaccggcgacggaagcgtttcgaacgggaagctggggacgtcgatgttcatagctccggcgtccggcccggcttcgtccgccggaaagccaccgatctcgagcgtgccgtacaagaagcggtgccacgagcacgacccctccgataacatctccggcaagcactccggctccggcagcggcaagtgccactgctccaaaagaaggaaaaaccgagtgaagaaggtgacgagagtgccggcgatcagcaacaagatcgcggacatcccggccgacgagttctcgtggaggaagtacggacagaagccgatcaaagggtctcccttcccacgaggttactacaagtgcagtacaatgagagggtgccccgcgaggaaacacgtggagagggcccccgacgatccaacgatgctgatcgtgacgtacgagggggagcatcgtcactcccagtccgcgtcgcaggagattgtgcccgccggtgcgatgaacctggtattcaagtcaacc

SEQ ID NO: 1521 - protein, 343 aa, Eucalyptus grandis
  Eucgr.C04011.1 polypeptide
MAIELHLGFSKMEDHTAIQEAASQGLKTMEHLIGVLSRQNLHHPGAVDCTDLTDRTVSKFRKVISLLDRTGHARFRRAPLPSSSSSSSKSAPVASPVPPAVQSRSQPLAPTPIQAPTSSQPSPASFLHAQPKQSLTLDFTRPSILGPNSKGVSEIEFAKDSFSVSSNSSFMSSAITGDGSVSNGKLGTSMFIAPASGPASSAGKPPISSVPYKKRCHEHDPSDNISGKHSGSGSGKCHCSKRRKNRVKKVTRVPAISNKIADIPADEFSWRKYGQKPIKGSPFPRGYYKCSTMRGCPARKHVERAPDDPTMLIVTYEGEHRHSQSASQEIVPAGAMNLVFKST

SEQ ID NO: 1522 - DNA, 1002 bp, Eucalyptus grandis
  Eucgr.C04011.2
atggcgatcgagctgcatcttggcttctccaagatggaggatcacacggcgatacaggaggccgcgtctcaggggctgaagaccatggagcacctgatcggcgtcctctcccgccagaacctccaccaccccggcgccgtcgactgcaccgacctcaccgaccggaccgtctccaagttcaggaaggtcatctccctcctggaccgcaccggccacgcccgcttccggcgggccccgctcccctcctcctcctcttcctcctccaagtctgcccccgtcgcttcccctgtccccccggcggttcagtctcggagccagcctctagcgccgacgcccatccaggccccgacgagctcgcagccgtctccggccagcttcctccacgcgcagcccaagcagagcttgaccctcgacttcacccggccgagcatcctgggccccaactccaaaggcgtttccgagatcgagttcgcgaaggacagcttcagcgtgtcgtccaactcttccttcatgtcttcggcgatcaccggcgacggaagcgtttcgaacgggaagctggggacgtcgatgttcatagctccggcgtccggcccggcttcgtccgccggaaagccaccgatctcgagcgtgccgtacaagaagcggtgccacgagcacgacccctccgataacatctccggcaagcactccggctccggcagcggcaagtgccactgctccaaaagaaggaaaaaccgagtgaagaaggtgacgagagtgccggcgatcagcaacaagatcgcggacatcccggccgacgagttctcgtggaggaagtacggacagaagccgatcaaagggtctcccttcccacgaggttactacaagtgcagtacaatgagagggtgccccgcgaggaaacacgtggagagggcccccgacgatccaacgatgctgatcgtgacgtacgagggggagcatcgtcactcccagtccgcgtcgcaggagattgtgcccggcggc

SEQ ID NO: 1523 - protein, 334 aa, Eucalyptus grandis
  Eucgr.C04011.2 polypeptide
MAIELHLGFSKMEDHTAIQEAASQGLKTMEHLIGVLSRQNLHHPGAVDCTDLTDRTVSKFRKVISLLDRTGHARFRRAPLPSSSSSSSKSAPVASPVPPAVQSRSQPLAPTPIQAPTSSQPSPASFLHAQPKQSLTLDFTRPSILGPNSKGVSEIEFAKDSFSVSSNSSFMSSAITGDGSVSNGKLGTSMFIAPASGPASSAGKPPISSVPYKKRCHEHDPSDNISGKHSGSGSGKCHCSKRRKNRVKKVTRVPAISNKIADIPADEFSWRKYGQKPIKGSPFPRGYYKCSTMRGCPARKHVERAPDDPTMLIVTYEGEHRHSQSASQEIVPGG

SEQ ID NO: 1524 - DNA, 921 bp, Oryza sativa
  LOC_Os08g13840.1
atggccgtggacctcatgggcttcagcccgcgcggcggctgccgcccgtccgtggagacggagcagctcgctttccaggaggccgccgccgcggggctccgcagcctcgagctgctcgtctcgtcgctctccgccgggggggagcaccaccaccgccgccgcccgcaggagaagcagtcttcgccgccgctgggggagatcgcggaccaggcggtgtccaggttcaggaaggtgatctcgattcttgaccggaccggccacgcccgcttccgccgtggccctgtcgtcggagcggcagctgcggaggcggctgccgcggcggcgtcggcgtcaccgtcgtcgtctcctgtctcgccgcctctcccgccggtgacgacgcagccggcggccgccgtgaagagcctgacgctggacttcacgaatcccgccaaggtcgcggcggcgtcggtgacctcgacgtcgttcttctcgtcggtcaccgccggcggagacggcagcgtgtccaagggccggagcctggtctcctccgggaagcccccgctcgccggcggcgtcaagcgcaagcacccgcacccgccctgcgccgccgccggcgacggccacggccacggcgcaggccacgcgcacgcgcacggcgggtgccactgctccaagaagcggaagcagcgggttcggcgcacggtgcgcgtggcggcggcgagcgcgcgggtggcggacatccccgccgacgagtactcgtggcgcaagtacgggcagaagccgatcaaggggtccccctacccgcgcggctactaccggtgcagcaccgtcaagggttgccccgcccggaagcacgtcgagcgcgccgccgacgaccccgccaccctcgtcgtcacctacgagggcgaccaccgccactcgccgccgccgccgccgcttgtt

SEQ ID NO: 1525 - protein, 307 aa, Oryza sativa
  LOC_Os08g13840.1 polypeptide
MAVDLMGFSPRGGCRPSVETEQLAFQEAAAAGLRSLELLVSSLSAGGEHHHRRRPQEKQSSPPLGEIADQAVSRFRKVISILDRTGHARFRRGPVVGAAAAEAAAAAASASPSSSPVSPPLPPVTTQPAAAVKSLTLDFTNPAKVAAASVTSTSFFSSVTAGGDGSVSKGRSLVSSGKPPLAGGVKRKHPHPPCAAAGDGHGHGAGHAHAHGGCHCSKKRKQRVRRTVRVAAASARVADIPADEYSWRKYGQKPIKGSPYPRGYYRCSTVKGCPARKHVERAADDPATLVVTYEGDHRHSPPPPPLV

SEQ ID NO: 1526 - DNA, 921 bp, Oryza sativa; identical to SEQ ID NO: 1524
  LOC_Os08g13840.2

SEQ ID NO: 1527 - protein, 307 aa, Oryza sativa; identical to SEQ ID NO: 1525
  LOC_Os08g13840.2 polypeptide

SEQ ID NO: 1528 - DNA, 894 bp, Zea mays
  GRMZM2G071907_T01
atggccgtggacctgatgggctgctacgccccgcgccgcgccaacgaccagctcgccatccaggaggcggcggcggccgggctccgcaacctggagctgctggtgacgtccctgtccacgcaggccgccgcgccgcacagagccgctgatcagccgttcggcgagatcgccggccaggccgtctccaagttccgcaaggtcatctccatcctcgaccgcacggggcacgcccgcttccgccgcgggcccgtcgagccgccgccgccgacgccgccgccgcctcctgtcgtccccggtcctgcccccctggcggccgtcagcgtggcgcagccgccgcagagcctgacgctggacttcacgaagccgaacctggccgtgtcggccgccacgtccgtcacctccacgtccttcttctcgtcggtcacggccggcgagggcagcgtctccaagggccggagcctcatgtcctccgggaagccgccgctgtccggccacaagcggaagccctgcgccggcgcccactccgaggccaccaccaacggcagccgttgccactgctccaagagaaggaagaaccgcgtgaagaggaccatcagagtgccggcgatcagctcgaaggtcgccgacatcccttcggacgagtactcgtggaggaagtacggccagaagcccatcaagggctccccttacccacggggctactacaagtgcagcactgtgcggggatgcccggcgaggaagcacgtggagcgggccaccgacgacccggccatgctggtggtgacgtacgagggcgagcaccgccacacgccgggcgcggtccaggggccgagccccctggcgaccgcgtcgccggtgcccgtcgccgtctccgccggcaacgggctcgttgtc

SEQ ID NO: 1529 - protein, 298 aa, Zea mays
  GRMZM2G071907_T01 polypeptide
MAVDLMGCYAPRRANDQLAIQEAAAAGLRNLELLVTSLSTQAAAPHRAADQPFGEIAGQAVSKFRKVISILDRTGHARFRRGPVEPPPPTPPPPPVVPGPAPLAAVSVAQPPQSLTLDFTKPNLAVSAATSVTSTSFFSSVTAGEGSVSKGRSLMSSGKPPLSGHKRKPCAGAHSEATTNGSRCHCSKRRKNRVKRTIRVPAISSKVADIPSDEYSWRKYGQKPIKGSPYPRGYYKCSTVRGCPARKHVERATDDPAMLVVTYEGEHRHTPGAVQGPSPLATASPVPVAVSAGNGLVV

SEQ ID NO: 1530 - DNA, 948 bp, Zea mays
  GRMZM2G091331_T01
atggccgtggacctgatggggtgctacgccccgcgccgcgccaacgaccagctcgccatccaggaggcggcggcggcggggctccgcagcctggagctcctcgtgtcgtcgctgtccacgcaggccgccgcgccgcacagggccgcggctcaccagctgcagaagccgccttcgcagccgccgatcggcgagatcgccgaccaggccgtctccaggttccgcaaggtcatctccatcctggaccgcaccggccacgcccgcttccggcgcgggcccgtggtcgaggcgccgccaccggtgcctcctccggccgtctccgctcccgctctccccgtggcgcacgtggtggctcccgtcggcgcggcgcagccccagagcctgaccctggacttcacgaagccgaacctggccgtgtcgggcggcgccacgtccgtcacctccacgtccttcttctcctcggtcacggccggcgagggcagcgtgtccaagggccgcagcctggtgtcctccggcaagccgccgctgtccggccacaagcggaagccctgcgccggcgcgcactccgaggccaccaccaacggcagccgctgccactgctccaagagaaggaaaaaccgcgtgaagaggaccatcagagtgccggcgatcagcgccaagatcgcggacatcccgccggacgagtactcgtggaggaagtacggccagaagcccatcaagggctccccctacccacggggctactacaagtgcagcaccgtgcgcgggtgcccggcgaggaagcacgtggagcgcgccaccgacgacccggccatgctggtggtgacgtacgagggcgagcaccgccacacgccgggcgcgcccgcgcccgcgcccagccccctggcggccgcgtcgccggtgcccgcctccgccgccgccgccgtctccgccggcaacaacgggcttgtc

SEQ ID NO: 1531 - protein, 316 aa, Zea mays
  GRMZM2G091331_T01 polypeptide
MAVDLMGCYAPRRANDQLAIQEAAAAGLRSLELLVSSLSTQAAAPHRAAAHQLQKPPSQPPIGEIADQAVSRFRKVISILDRTGHARFRRGPVVEAPPPVPPPAVSAPALPVAHVVAPVGAAQPQSLTLDFTKPNLAVSGGATSVTSTSFFSSVTAGEGSVSKGRSLVSSGKPPLSGHKRKPCAGAHSEATTNGSRCHCSKRRKNRVKRTIRVPAISAKIADIPPDEYSWRKYGQKPIKGSPYPRGYYKCSTVRGCPARKHVERATDDPAMLVVTYEGEHRHTPGAPAPAPSPLAAASPVPASAAAAVSAGNNGLV

SEQ ID NO: 1532 - protein, 50 aa, Arabidopsis thaliana
  AT2G24570.1 Plant zinc cluster domain
RKRCFEHDHSEGFSGKISGSGNGKCHCKKSRKNRMKRTVRVPAVSAKIAD

SEQ ID NO: 1533 - protein, 50 aa, Arabidopsis thaliana
  AT4G31550.1 Plant zinc cluster domain
RKRCLEHEHSESFSGKVSGSAYGKCHCKKSRKNRMKRTVRVPAISAKIAD

SEQ ID NO: 1534 - protein, 45 aa, Glycine max
  Glyma14g17730.1 Plant zinc cluster domain
KKRCHEHREHSGDVSGNSKCHCVKRRKNRVKNTVRVPAISSKIAD

SEQ ID NO: 1535 - protein, 45 aa, Glycine max
  Glyma17g29190.1 Plant zinc cluster domain
KKRCHEHREHSDDVSGNSKCHCVKRRKNRVKSTVRVPAISSKVAD

SEQ ID NO: 1536 - protein, 49 aa, Glycine max
  Glyma06g08120.1 Plant zinc cluster domain
KKRCHDHREHSDEISGKLSGSSKCHCTKRRKNRVKKTVRVPVISSKIAD

SEQ ID NO: 1537 - protein, 46 aa, Solanum lycopersicum
  Solyc12g096350.1.1 Plant zinc cluster domain
RCREHEQSDAISGSKSTGSGKCHCKKRKAKDRKVIRIPAISTRVAD

SEQ ID NO: 1538 - protein, 53 aa, Citrus clementina
  clementine0.9_014855m Plant zinc cluster domain
KKRCQDHKDHSDDLSGKFSGSTSGNNKCHCSKRRKNRVKKTIRVPAISSKIAD

SEQ ID NO: 1539 - protein, 50 aa, Eucalyptus grandis
  Eucgr.C04011.1 Plant zinc cluster domain
KKRCHEHDPSDNISGKHSGSGSGKCHCSKRRKNRVKKVTRVPAISNKIAD

SEQ ID NO: 1540 - protein, 50 aa, Eucalyptus grandis; identical to SEQ ID NO: 1539
  Eucgr.C04011.2 Plant zinc cluster domain

SEQ ID NO: 1541 - protein, 49 aa, Oryza sativa
  LOC_Os08g13840.1 Plant zinc cluster domain
HPPCAAAGDGHGHGAGHAHAHGGCHCSKKRKQRVRRTVRVAAASARVAD

SEQ ID NO: 1542 - protein, 49 aa, Oryza sativa; identical to SEQ ID NO: 1541
  LOC_Os08g13840.2 Plant zinc cluster domain

SEQ ID NO: 1543 - protein, 43 aa, Zea mays
  GRMZM2G071907_T01 Plant zinc cluster domain
RKPCAGAHSEATTNGSRCHCSKRRKNRVKRTIRVPAISSKVAD

SEQ ID NO: 1544 - protein, 43 aa, Zea mays
  GRMZM2G091331_T01 Plant zinc cluster domain
RKPCAGAHSEATTNGSRCHCSKRRKNRVKRTIRVPAISAKIAD

SEQ ID NO: 1545 - protein, 59 aa, Arabidopsis thaliana
  AT2G24570.1 WRKY DNA-binding domain
PPDEYSWRKYGQKPIKGSPHPRGYYKCSTFRGCPARKHVERALDDSTMLIVTYEGEHRH

SEQ ID NO: 1546 - protein, 59 aa, Arabidopsis thaliana
  AT4G31550.1 WRKY DNA-binding domain
PPDEYSWRKYGQKPIKGSPHPRGYYKCSTFRGCPARKHVERALDDPAMLIVTYEGEHRH

SEQ ID NO: 1547 - protein, 59 aa, Glycine max
  Glyma14g17730.1 WRKY DNA-binding domain
PPDEYSWRKYGQKPIKGSPYPRGYYKCSTVRGCPARKHVERAPDDPAMLIVTYEGEHRH

SEQ ID NO: 1548 - protein, 59 aa, Glycine max
  Glyma17g29190.1 WRKY DNA-binding domain
PPDEYSWRKYGQKPIKGSPYPRGYYKCSTIRGCPARKHVERAPDDPAMLIVTYEGEHRH

SEQ ID NO: 1549 - protein, 59 aa, Glycine max
  Glyma06g08120.1 WRKY DNA-binding domain
PPDEYSWRKYGQKPIKGSPYPRGYYKCSSVRGCPARKHVERAPDDPTMLIVTYEGEHRH

SEQ ID NO: 1550 - protein, 59 aa, Solanum lycopersicum
  Solyc12g096350.1.1 WRKY DNA-binding domain
PGDEFSWRKYGQKPIKGSKYPRGYYKCSSLRGCPARKHVERAMDDPTMLIVTYEDEHCH

SEQ ID NO: 1551 - protein, 59 aa, Citrus clementina
  clementine0.9_014855m WRKY DNA-binding domain
PPDEYSWRKYGQKPIKGSPYPRGYYKCSTMRGCPARKHVERAPDDPTMLIVTYEGEHRH

SEQ ID NO: 1552 - protein, 59 aa, Eucalyptus grandis
  Eucgr.C04011.1 WRKY DNA-binding domain
PADEFSWRKYGQKPIKGSPFPRGYYKCSTMRGCPARKHVERAPDDPTMLIVTYEGEHRH

SEQ ID NO: 1553 - protein, 59 aa, Eucalyptus grandis; identical to SEQ ID NO: 1552
  Eucgr.C04011.2 WRKY DNA-binding domain

SEQ ID NO: 1554 - protein, 59 aa, Oryza sativa
  LOC_Os08g13840.1 WRKY DNA-binding domain
PADEYSWRKYGQKPIKGSPYPRGYYRCSTVKGCPARKHVERAADDPATLVVTYEGDHRH

SEQ ID NO: 1555 - protein, 59 aa, Oryza sativa; identical to SEQ ID NO: 1554
  LOC_Os08g13840.2 WRKY DNA-binding domain

SEQ ID NO: 1556 - protein, 59 aa, Zea mays
  GRMZM2G071907_T01 WRKY DNA-binding domain
PSDEYSWRKYGQKPIKGSPYPRGYYKCSTVRGCPARKHVERATDDPAMLVVTYEGEHRH

SEQ ID NO: 1557 - protein, 59 aa, Zea mays
  GRMZM2G091331_T01 WRKY DNA-binding domain
PPDEYSWRKYGQKPIKGSPYPRGYYKCSTVRGCPARKHVERATDDPAMLVVTYEGEHRH

SEQ ID NO: 1558 - protein, 11 aa, Arabidopsis thaliana
  WRKY17 clade C-region motif calmodulin-binding consensus domain
  misc_feature (2)..(2): Xaa can be Ser or Ala
  misc_feature (3)..(3): Xaa can be any naturally occurring amino acid
  misc_feature (5)..(5): Xaa can be Lys or Arg
  misc_feature (6)..(6): Xaa can be any naturally occurring amino acid
  misc_feature (7)..(7): Xaa can be Ile, Leu, Val, or Met
  misc_feature (9)..(10): Xaa can be Ile, Leu, Val, or Met
VXXFXXXIXXL

SEQ ID NO: 1559 - protein, 11 aa, Arabidopsis thaliana
  WRKY17 clade GHARFRR consensus domain
  misc_feature (2)..(2): Xaa can be Ser or Thr
  misc_feature (10)..(10): Xaa can be Gly, Ala, or Ser
RXGHARFRRXP

SEQ ID NO: 1560 - protein, 27 aa, Arabidopsis thaliana
  WRKY17 clade plant zinc cluster consensus domain
  misc_feature (2)..(2): Xaa can be His or Gln
  misc_feature (4)..(4): Xaa can be any naturally occurring amino acid
  misc_feature (6)..(6): Xaa can be any naturally occurring amino acid
  misc_feature (9)..(9): Xaa can be Asn, Gln, or Ala
  misc_feature (10)..(10): Xaa can be Lys or Arg
  misc_feature (11)..(11): Xaa can be any naturally occurring amino acid
  misc_feature (12)..(12): Xaa can be Lys or Arg
  misc_feature (13)..(15): Xaa can be any naturally occurring amino acid
  misc_feature (17)..(17): Xaa can be Ile, Leu, Val, or Met
  misc_feature (18)..(18): Xaa can be Pro or Ala
  misc_feature (19)..(19): Xaa can be Val or Ala
  misc_feature (20)..(20): Xaa can be Ile, Leu, Val, Met, or Ala
  misc_feature (22)..(22): Xaa can be any naturally occurring amino acid
  misc_feature (23)..(23): Xaa can be Lys or Arg
  misc_feature (24)..(24): Xaa can be Ile, Leu, Val, Met, or Ala
  misc_feature (26)..(26): Xaa can be Asp or Glu
CXCXKXRKXXXXXXXRXXXXSXXXAXI

SEQ ID NO: 1561 - protein, 59 aa, Arabidopsis thaliana
  WRKY17 clade DNA -binding consensus domain
  misc_feature (2)..(2): Xaa can be any naturally occurring amino acid
  misc_feature (4)..(4): Xaa can be Asp or Glu
  misc_feature (5)..(5): Xaa can be Tyr or Phe
  misc_feature (19)..(19): Xaa can be Pro or Lys
  misc_feature (20)..(20): Xaa can be Tyr, Phe, or His
  misc_feature (26)..(26): Xaa can be Lys or Arg
  misc_feature (29)..(29): Xaa can be Ser or Thr
  misc_feature (30)..(30): Xaa can be Ile, Leu, Val, Met, or Phe
  misc_feature (31)..(31): Xaa can be Lys or Arg
  misc_feature (43)..(43): Xaa can be any naturally occurring amino acid
  misc_feature (45)..(45): Xaa can be Asp, Asn, or Glu
  misc_feature (46)..(46): Xaa can be Pro or Ser
  misc_feature (47)..(47): Xaa can be Ser, Ala, or Thr
  misc_feature (48)..(48): Xaa can be any naturally occurring amino acid
  misc_feature (50)..(50): Xaa can be Ile, Leu, Val, or Met
  misc_feature (55)..(55): Xaa can be any naturally occurring amino acid
  misc_feature (56)..(56): Xaa can be Asp or Glu
  misc_feature (58)..(58): Xaa can be any naturally occurring amino acid
PXDXXSWRKYGQKPIKGSXXPRGYYXCSXXXGCPARKHVERAXDXXXXLXVTYEXXHXH

SEQ ID NO: 1562 - DNA, 933 bp, Brachypodium distachyon
  Bradi5g04817.1
atgatgaccatggatctgatgggaggatacgggcgggcggacgagcaggcggcgatccaggaggcggcggcggcggggctgcgcgggatggagcacctcatcctgcggctctcccagacgggcaccggcgccgagagctccccggccgtcgcggcaccggagcaggccaaggggaagcagcagcagcagcaggagcaggtggactgcagggagatcacggacatgacggtgtccaagttcaagaaggtgatctccatcctcaaccgcaccggccacgccaggttccggcgcggccccgtggtggcgcagtcccagggccccgagcaccagcagcaggcgccggtggtagtaaggtcttcttccgtgacgctggacttcaccaaggccgggtacgggaataaggacgccgggctgagcgtctctgccgcgaccgcgagctcgtcgtttctgtcgtcggtgaccggtgacgggagcgtgtccaacgggcgcgctggcgtgtcctcttccatggtgttcccgccgccgccttcggccagctgcgggaagccgccgctggctgcgaagcacaagtgccacgaccacgcgcactccgagaacgtcgccggcgcctccggtggccgctgccactgctccaagcgcaggaagtctcgggtgaggcggatgacccgcgtgccggccatcagttccaaggcggccgagatcccggccgacgatttctcgtggcgcaagtacgggcagaagcccatcaagggctccccctatccgcgaggctactacaaatgcagcacggtgcgcgggtgcccggcgcggaagcacgtggagcgcgaccccagcgagccctccatgctcatcgtcacctacgaaggcgaccaccgccacgcgcccgccgaccaggagccgccgccgccgccgctcgccgcactccacgagctt

SEQ ID NO: 1563 - protein, 311 aa, Brachypodium distachyon
  Bradi5g04817.1 polypeptide
MMTMDLMGGYGRADEQAAIQEAAAAGLRGMEHLILRLSQTGTGAESSPAVAAPEQAKGKQQQQQEQVDCREITDMTVSKFKKVISILNRTGHARFRRGPVVAQSQGPEHQQQAPVVVRSSSVTLDFTKAGYGNKDAGLSVSAATASSSFLSSVTGDGSVSNGRAGVSSSMVFPPPPSASCGKPPLAAKHKCHDHAHSENVAGASGGRCHCSKRRKSRVRRMTRVPAISSKAAEIPADDFSWRKYGQKPIKGSPYPRGYYKCSTVRGCPARKHVERDPSEPSMLIVTYEGDHRHAPADQEPPPPPLAALHEL

SEQ ID NO: 1564 - DNA, 978 bp, Oryza sativa
  LOC_Os04g21950.1
atgattaccatggatctgatgggtgggtacgggcgggtggacgagcaggtggccatccaggaggcggcggcggcggggctaagggggatggagcatcttattctgcagctgtcccagactgggacgagcgagaggtcgccggcgccggcgcaggagcagcagcaacaggtggactgcagggagatcacggacatgacggtgtccaagttcaagaaggtgatctccatgctgaaccgcaccggccacgcgcggttccggcggggcccggtggtggcgcagtcgtcgggcccggcggcgtccgagccggcgccggtgaggtcgtccccgtcggcggtgtcgaggcccatgacgctcgacttcaccaaggcggcgtccgggtacggcaaggacgccgggttcagcgtctccggcatctccgccgcgagctcgtccttcctctcgtcggtcaccggcgacggcagcgtgtccaacgggcgcggcggcgggtcatcctccctgatgcttcccccgccgccggcgaccagctgcggcaagccaccgctgtcctccgccgccgccgccatgtcagccggcgcaggccacaagcgcaagtgccacgaccacgcgcactccgagaacgtcgccggcggcaagtacggatccaccggcggccgctgccactgctccaagcgccggaagcatcgggtgaagaggacgatccgcgtgccggcgataagctcgaaggtggcggacatccccgccgacgacttctcgtggcggaagtacgggcagaagcccatcaagggctcccccttcccacgaggatactacaagtgtagcacgctgcgcggttgcccggcgaggaagcacgtggagcgcgacccgaccgacccgtccatgctcatcgtcacctacgagggcgagcaccgccactccccctccgccgccggccaggaccacccgccggcgccgcctccgccgctggcgctgccgctcgcc

SEQ ID NO: 1565 - protein, 326 aa, Oryza sativa
  LOC_Os04g21950.1 polypeptide
MITMDLMGGYGRVDEQVAIQEAAAAGLRGMEHLILQLSQTGTSERSPAPAQEQQQQVDCREITDMTVSKFKKVISMLNRTGHARFRRGPVVAQSSGPAASEPAPVRSSPSAVSRPMTLDFTKAASGYGKDAGFSVSGISAASSSFLSSVTGDGSVSNGRGGGSSSLMLPPPPATSCGKPPLSSAAAAMSAGAGHKRKCHDHAHSENVAGGKYGSTGGRCHCSKRRKHRVKRTIRVPAISSKVADIPADDFSWRKYGQKPIKGSPFPRGYYKCSTLRGCPARKHVERDPTDPSMLIVTYEGEHRHSPSAAGQDHPPAPPPPLALPLA

SEQ ID NO: 1566 - DNA, 993 bp, Zea mays
  GRMZM2G102583_T02
atgacgaccctcgatctgatgggagggtacgggcgggtggacgagcaggtggccatccaggaggccgccacggcggggctgcgcgggatggagcgtctcatcttgcagctctcccaggctggcaccggggagcggtcgttgtccccaccggcggtacaggcgcagcgccagcagcagaagcagctggagcagatccagcagcaggttgactgccgggagctcacggacatgacggtgtccaagttcaagaaggtgatctccatcctgaaccgcacggggcacgcgcggttccggcgtggccccgtggcggcgcggtcgcagtcgcagtcgcagggacctgcctcccccgagcccgcgcaatcggcgccggctcccgccgcgaggcccctgacgctggacttcaccaagtcggtgtccggttacagcagggactccgggttcagcgtgtccggcgcgagctcgtcgttcctgtcgtcggtgacgaccggggacgggagcgtgtcgaacgggcgcgcgggaggctcgtcgttcctcatgttcccaccggcgcccggcgcggccagctgcgcgaagccgccgcccgccggtgcggcgcagaagcgcaagtgccacgaccacgcgcactcggagaacgtcgccggcggcaagtacggggctaacggcgggcgctgccactgctcgaagcgcaggaagcaccgtgtgaagcgcacgatccgcgtgccggcgatcagccccaaagtggcggacatccccgccgacgagtactcgtggcgcaagtacggccagaaacccatcaaggggtcgccctacccacgcggctactacaagtgcagcacggtgcgcggctgccccgcccggaagcatgtggagcgcgaccccgccgacccgtcgatgctgatcgtcacctacgagggcgagcaccgccacagccccgcctccggccaggacccgccgccgccgtcgctcgcgccgctgccggagctgcccagccat

SEQ ID NO: 1567 - protein, 331 aa, Zea mays
  GRMZM2G102583_T02 polypeptide
MTTLDLMGGYGRVDEQVAIQEAATAGLRGMERLILQLSQAGTGERSLSPPAVQAQRQQQKQLEQIQQQVDCRELTDMTVSKFKKVISILNRTGHARFRRGPVAARSQSQSQGPASPEPAQSAPAPAARPLTLDFTKSVSGYSRDSGFSVSGASSSFLSSVTTGDGSVSNGRAGGSSFLMFPPAPGAASCAKPPPAGAAQKRKCHDHAHSENVAGGKYGANGGRCHCSKRRKHRVKRTIRVPAISPKVADIPADEYSWRKYGQKPIKGSPYPRGYYKCSTVRGCPARKHVERDPADPSMLIVTYEGEHRHSPASGQDPPPPSLAPLPELPSH

SEQ ID NO: 1568 - DNA, 888 bp, Glycine max
  Glyma09g06980.1
atgatggcattggatatgattgatgttgttcccaggacgaggatggaagaagaaaatatagcaatacaagaagcagcttccgctgggttaaagagcatggagcatctcattcgtctcctttctccttcttcttctcttcacaacaacgttaataatctcaatctcaaccacctcgactgctccgaaatcaccggcttcactgtctccaagttcaaacaagtcatcaaccttctcaaccgcaccggccacgcccgcttccgccgctctccaccccaagcccaagcccaagcccaagcccaagcccaagcccaaactaatcctcaaccacaacctcagatccaacaacaagggttcagtttagatttcgtgaagcccaccattctaaactcaaagcccatcaacaaagacgaaactttgactctttcaacaacctcttcttccttcatgtcctccgtcaccaacgacgccagcgtctccgacggcaagatcggacctttcctccctccctccgccgccaaaccccctctctcctccgcccaccggaaaaagtgccgcgacgccgccgcagcactctccgccaaaccctcctgccactgctccaagaaaaggaaatcacgcgtgaaacgaacgattcgggtgccggcgataagctcaaagatcgcagatatcccaccggacgagtattcgtggagaaaatacggtcaaaaaccgatcaagggctcaccttaccctcgagggtactacaagtgcagcaccgtgagagggtgtccggcgaggaagcacgtggagcgagcgcaggatgaccccaagatgctaatagtgacttacgagggtgagcaccgtcacgtgctgccgttaacttccgccgccggcgttagtttcggccat

SEQ ID NO: 1569 - protein, 296 aa, Glycine max
  Glyma09g06980.1 polypeptide
MMALDMIDVVPRTRMEEENIAIQEAASAGLKSMEHLIRLLSPSSSLHNNVNNLNLNHLDCSEITGFTVSKFKQVINLLNRTGHARFRRSPPQAQAQAQAQAQAQTNPQPQPQIQQQGFSLDFVKPTILNSKPINKDETLTLSTTSSSFMSSVTNDASVSDGKIGPFLPPSAAKPPLSSAHRKKCRDAAAALSAKPSCHCSKKRKSRVKRTIRVPAISSKIADIPPDEYSWRKYGQKPIKGSPYPRGYYKCSTVRGCPARKHVERAQDDPKMLIVTYEGEHRHVLPLTSAAGVSFGH

SEQ ID NO: 1570 - DNA, 879 bp, Glycine max
  Glyma15g18250.1
atgatggcattggatatgatagatgttgttccgagaacgaggatggaggaagctgcttccgctggattaaagagcatggagcatctcattcgactcctttctccaacctcttctaattccaattcttcttcttctcctcttctcaataccaatcccaacaacctccactgctcccaaatcaccgacttcaccgtctccaacttcaaacaagtcatcaaccttctcaaccgcaccggccacgcccgcttccgccgctctccaccccaagcccaagcccaagcccaaacccaaacccaaacccaaacaagtcttcagcctcaaccagaaacccaacaagggttcagtttagatttcgtgaagcccaccattctaaactcaaaacccagcaacaaagacgagactttgaccctctccaccacctcctcctcctccttcacgtcctccgtcaccaacgacgccagcgtctccgacggcaagatcggccctttcctccctccctccgccgccaagccacctctctcctccgcccaccggaaaaagtgccgcgacgctgccgccgcgctctccaccaaaccctcctgccactgctccaagaaaaggaaatcacgcgtgaaacgaacgattcgtgtgccggcggtaagctccaagatcgccgatatcccatcggacgagtactcgtggagaaaatacggtcaaaaaccgatcaagggttcaccttaccctcgagggtactacaagtgcagcaccgtgagagggtgtccggcgaggaagcacgtggagcgagcgcaagataaccccaagatgctaatagtgacttacgagggtgagcaccgtcacgttcttccgttaactgccgctgccggcgttagtttcggccat

SEQ ID NO: 1571 - protein, 293 aa, Glycine max
  Glyma15g18250.1 polypeptide
MMALDMIDVVPRTRMEEAASAGLKSMEHLIRLLSPTSSNSNSSSSPLLNTNPNNLHCSQITDFTVSNFKQVINLLNRTGHARFRRSPPQAQAQAQTQTQTQTSLQPQPETQQGFSLDFVKPTILNSKPSNKDETLTLSTTSSSSFTSSVTNDASVSDGKIGPFLPPSAAKPPLSSAHRKKCRDAAAALSTKPSCHCSKKRKSRVKRTIRVPAVSSKIADIPSDEYSWRKYGQKPIKGSPYPRGYYKCSTVRGCPARKHVERAQDNPKMLIVTYEGEHRHVLPLTAAAGVSFGH

SEQ ID NO: 1572 - DNA, 972 bp, Glycine max
  Glyma13g00380.1
atgacagtagatctggtaggtgctgccaagatggggatggaggagaatatagcgatacaagaagctgcttccgctgggttgaagagtatggagcatctgattcgtgtgctttcttctcaaatcccttcttctgcttcgtcttcttctaacgcacaccaccaccgtcttaatctcaaccaccttgactgcaccgaaatcaccgacttcactgtctccaagttcaaacaagtcatcaacttgttgaatcgcacgggacacgctcgctttcgtagcgcaccttctcatccttctccttctacttctcttccttctcaacctcaacctcaaccacaaccacaaccatatgcactgactcttgatttcgcaaaacctgttatgcttaagtcaaatcccaaccctaacccttcttctaccgatttgtcggtttctcaatattctaagaccaaggacaccaccacctctagtatatctcctcccgtgtccaccaccacctcctcattcatgtcctccatcaccgccgacggaagtgtctccgacggaaagatcggccccgccatcatcgctgccggcaagcctcctctctcctcatcccaccggaaaaggtgtcacgacgccaccctctctgccggaaaagcctcttcctccgctcactgccattgctccaagagaagaaaatctcgtgtgaaacgaatgatacgtgtgccggcgataagttcgaagattgccgatatcccagtggacgagtactcatggcgaaagtatggtcaaaaaccaatcaaaggttcaccttacccgcgagggtattacaagtgcagtagcgtgagagggtgtccggcgaggaagcacgttgagcgagcccaggatgaccccaacatgctcatcgttacctacgagggagagcaccgtcatccgcaaccgcgtctgccggaaactgctgccggcgccggcgggacttttgccgctcatcctgtt

SEQ ID NO: 1573 - protein, 324 aa, Glycine max
  Glyma13g00380.1 polypeptide
MTVDLVGAAKMGMEENIAIQEAASAGLKSMEHLIRVLSSQIPSSASSSSNAHHHRLNLNHLDCTEITDFTVSKFKQVINLLNRTGHARFRSAPSHPSPSTSLPSQPQPQPQPQPYALTLDFAKPVMLKSNPNPNPSSTDLSVSQYSKTKDTTTSSISPPVSTTTSSFMSSITADGSVSDGKIGPAIIAAGKPPLSSSHRKRCHDATLSAGKASSSAHCHCSKRRKSRVKRMIRVPAISSKIADIPVDEYSWRKYGQKPIKGSPYPRGYYKCSSVRGCPARKHVERAQDDPNMLIVTYEGEHRHPQPRLPETAAGAGGTFAAHPV

SEQ ID NO: 1574 - DNA, 984 bp, Solanum lycopersicum
  Solyc08g006320.2.1
atggctgtagatttgttaaattattcgaatttgaatgaacaattagctttacaagaagctgctacagccggtttaaaatctatggataatttaatccggttcgtttcatttcaacaacagcaaaatcaaacggttcagccggattgtagagagataactgattatactgtttcgaattttagaaaggttattactattttgaaccggaccggtcatgcccggtttagacgtagtccggttcaggttactgatgattcgtctacggctttaactctatcgccgttgacaaatccggcggaggaaactgtaccggcggtgaaagtaccggttgagaagtatcaatcgaaggcgttgactttagattttacgaaacggaaagttggtaaatctattggatgtgaagctgttccggtagcgagttcgacgacgtcgtcgtcgtttatgtcgacgattacaggtgaaggaagtgtttcgaatggtaaagtgttttcgtcgatgagtttacctcctcgtccgcctgtttcctccgggaagccgccaatcgccgggaaaagatgtcgtgatcatgagctgtctgatgaattttccggtagaacttctagctccgggaagtgtcagtgcaaaaagaggaaatctcgagtaaaaaaagtgatcagagttccggcgatcagttcaaaaactgctgatattccggcagatgaatactcatggagaaagtacggtcaaaagccgatcaaaggttcaccatacccaaggggatattaccgatgtagtagtgttagaggctgtccggcgagaaagcacgtagaaagagccaccgatgatcctggaatgcttgttgtgacttacggcggagagcatcgtcatgttcaaaccacgatctccggcaacgtcaccggcgctggagctggaagttccggcgagagaatgatggcttttgagttaacaggacagaaaaatggagaaagattagggttagagatt

SEQ ID NO: 1575 - protein, 328 aa, Solanum lycopersicum
  Solyc08g006320.2.1 polypeptide
MAVDLLNYSNLNEQLALQEAATAGLKSMDNLIRFVSFQQQQNQTVQPDCREITDYTVSNFRKVITILNRTGHARFRRSPVQVTDDSSTALTLSPLTNPAEETVPAVKVPVEKYQSKALTLDFTKRKVGKSIGCEAVPVASSTTSSSFMSTITGEGSVSNGKVFSSMSLPPRPPVSSGKPPIAGKRCRDHELSDEFSGRTSSSGKCQCKKRKSRVKKVIRVPAISSKTADIPADEYSWRKYGQKPIKGSPYPRGYYRCSSVRGCPARKHVERATDDPGMLVVTYGGEHRHVQTTISGNVTGAGAGSSGERMMAFELTGQKNGERLGLEI

SEQ ID NO: 1576 - DNA, 927 bp, Oryza sativa
  LOC_Os04g51560.1
atggccgtggacctgatgggctgctacgccccgcgccgcgcagacgaccagctcgccatccaggaggcggccaccgccggcctccgcagcctggagatgctcgtgtcgtccctctcctcctcctctcaggccgccggggctcacaaggcctcgccgcagcagcagccgttcggcgagatcgccgaccaggccgtctccaagttccgcaaggtcatctccatcctcgaccgcaccggccacgcccgcttccgccgcggcccggtcgagtcgtctgctcccgccgcccccgtcgctgctgctccccctcctcctcctccaccaccggcgccggtcgctgccgccctcgcgccgacctcctcgcagccgcagaccctgacgctggacttcacgaagccgaacctgaccatgtcggccgcgacgtccgtgacatccacgtcgttcttctcgtcggtgacggccggcgagggaagcgtttccaagggccggagcctgctctcctccggcaagccgccgctgtctgggcacaagcggaagccctgcgccggcggccactccgaggccaccgccaacggcggccgctgccactgctccaagagaaggaagaaccgggtgaagaggacgatccgagtgccggcaatcagctcgaagatcgccgacatcccgccggacgaatactcgtggaggaagtacggccagaaacccatcaagggctccccttacccacggggctactacaagtgcagcacagtgagaggatgccccgcgcggaagcacgtggagcgcgccaccgacgacccggcgatgctggtcgtgacctacgagggcgagcaccgccacacgccggggcccctcccggcgccacccgccgccgccgccgtcgccgcgatgccggtgtccgtcgccgtgtccaccggcaacggacatgtc

SEQ ID NO: 1577 - protein, 309 aa, Oryza sativa
  LOC_Os04g51560.1 polypeptide
MAVDLMGCYAPRRADDQLAIQEAATAGLRSLEMLVSSLSSSSQAAGAHKASPQQQPFGEIADQAVSKFRKVISILDRTGHARFRRGPVESSAPAAPVAAAPPPPPPPPAPVAAALAPTSSQPQTLTLDFTKPNLTMSAATSVTSTSFFSSVTAGEGSVSKGRSLLSSGKPPLSGHKRKPCAGGHSEATANGGRCHCSKRRKNRVKRTIRVPAISSKIADIPPDEYSWRKYGQKPIKGSPYPRGYYKCSTVRGCPARKHVERATDDPAMLVVTYEGEHRHTPGPLPAPPAAAAVAAMPVSVAVSTGNGHV

SEQ ID NO: 1578 - DNA, 1014 bp, Populus trichocarpa
  POPTR_0018s03450.1
atggcggtagagctgatgagttttaacacaaagatggatgatcagtcggctatacaagaggctgcgtcacaaggaattaagagcatggaacacttgatccgaatcatgtctcaccaaaataatcatcacgttgccgattgcactgaccttactgatgtaaccgtttccaagttcaagaaagtcatttccatcttaaaccgaacaggtcacgcccggttccgtcgtggcccgattcaacccaaccagccggccaagtcttcgttttccctctctccaccctccacatcgacacaatcaccgcaatcacagtctcagtccccctccttctctcgcttccaaaacctaaccctaactccacagcaaatcacaactccggtcaccgcaccggcggcgccgacgagtctgacgcttgatttcacgaaaccgaatatatttagctccaagagtgcagagattgagttctcgaaggatagtttcagtgtctcttcgaactcggcgtcgtttatgtcgtcggggataaccggagacggcagcgtttctaatggaaagcaaggatcgtcgattttcttaggatccgctggcaagccgccgctctcgacggtgccgtacagcaacaagaagcggtgccatgagcatcatcatgatgacactgtctctggctcctctagtggcaagtgccattgctcttccaagagaaggaagaatcgggtgaagaaaacaatcagggttccagcaataagttcaaaaatagctgatattccaccagatgagtattcttggagaaaatatggtcaaaaaccaatcaagggatcaccatacccaaggggatattacaagtgcagtacaatgagagggtgcccggcaaggaaacatgtggagagagcaacagatgatccagccatgttgattgtaacctacgagggagagcactgccatactcaaggtgcaatggagggtaacatggctgccggaactgttaacttggtgttcgagtcaaccatgatggtaggggaa

SEQ ID NO: 1579 - protein, 338 aa, Populus trichocarpa
  POPTR_0018s03450.1 polypeptide
MAVELMSFNTKMDDQSAIQEAASQGIKSMEHLIRIMSHQNNHHVADCTDLTDVTVSKFKKVISILNRTGHARFRRGPIQPNQPAKSSFSLSPPSTSTQSPQSQSQSPSFSRFQNLTLTPQQITTPVTAPAAPTSLTLDFTKPNIFSSKSAEIEFSKDSFSVSSNSASFMSSGITGDGSVSNGKQGSSIFLGSAGKPPLSTVPYSNKKRCHEHHHDDTVSGSSSGKCHCSSKRRKNRVKKTIRVPAISSKIADIPPDEYSWRKYGQKPIKGSPYPRGYYKCSTMRGCPARKHVERATDDPAMLIVTYEGEHCHTQGAMEGNMAAGTVNLVFESTMMVGE

SEQ ID NO: 1580 - DNA, 918 bp, Brachypodium distachyon
  Bradi3g18580.1
atggccgtcgacctgatgggacgcggcggcgggtacagcgccccgcgcgccgagcaggagcagcagcgcgcgttccaggacgccgccaccgcggggctccgcagcctggagctcctcgtctcctccctctcccctcgcgccgccgaccgagccacggcagccccgctcggcgagatcgcggaccagacggtctccaggttccgccgcgtcatcaacatgctcgaccgcaccggccacgcccgcttccgccgcggccccgtcgtctcttccccatcccccgccccaactccatcaaagccccctccggtctcttcttcttccccagcaccggcaccggcaccggcagtagcgcctgcgccaccgaagacgctcaccctggacttcaccaagcccaccaaggcagccgcatccgtgacttccacatccttcttctcctcggtcaccgcagccgggtgcggcggcggcggcggcgagggcagcgtctccaagggccagggccagatcgcgatctcctcgggcaagccgcccctcgccgcgggcaccaagcgcaagctccaacagcaactccagcagcagcagcagccgtgcgcgagcggcgcgcactcggacgcggcggcgccgtgccactgcgcgtcctcgaagaagcgcaagagccgggcgtcgaggcgcgccgtgcgcgtgccggccacgagcgcgcgcgccgccgacatccccggggacgagttctcctggcgcaagtacgggcagaagcccatcaagggctccccttacccgcggggatactacaagtgcagcaccgtcaaggggtgtccggcaaggaaacacgtcgagcgcgccaccgatgaccccgccatgctcgtcgtcacctacgagggcgaccaccgccacggcgccgacctccctgcgccggccgccaat

SEQ ID NO: 1581 - protein, 306 aa, Brachypodium distachyon
  Bradi3g18580.1 polypeptide
MAVDLMGRGGGYSAPRAEQEQQRAFQDAATAGLRSLELLVSSLSPRAADRATAAPLGEIADQTVSRFRRVINMLDRTGHARFRRGPVVSSPSPAPTPSKPPPVSSSSPAPAPAPAVAPAPPKTLTLDFTKPTKAAASVTSTSFFSSVTAAGCGGGGGEGSVSKGQGQIAISSGKPPLAAGTKRKLQQQLQQQQQPCASGAHSDAAAPCHCASSKKRKSRASRRAVRVPATSARAADIPGDEFSWRKYGQKPIKGSPYPRGYYKCSTVKGCPARKHVERATDDPAMLVVTYEGDHRHGADLPAPAAN

SEQ ID NO: 1582 - DNA, 903 bp, Populus trichocarpa
  POPTR_0006s07170.1
atggctgtggatctagttaggtattcaaagatggaagatcagatggctatacaagaagctgcatcagctgggctcgagagcatggagcacttgatctttgcattctctaaccaaactcgacaaagccaccaacttgactgcggagaaatcacaaacttcaccgttgctaagttcaagcaagtcatctccatgttgaaccggaccggtcatgcccgttttcgccgtggaccaacttcttctccttcttcctacccggttcccgtccgacctgtccctcaagagcctcaaaaactgaaccttgattttgttaacagtaatagcccccctaaagctgagtcgaaaaatgacctgtctttgggtagtcagtattcaaaggatagccttagctctggcaccactacctcatccttcgtgtcttctgttacagctgatgggagtgtctctaatgggaaacaaggtggctcttctcttttcggaactcaagcgcgatctaccggaaaaccacctctctcatcgacccaccgcaagaaatgccacgatcatgccctctccgccagaaagatctcctccggtggaagctgtcattgctccaaaagaaggaaatcaagggttaagaggacaataagggtaccagccgtgagttccaagattgccgatataccagcagatgagtactcatggagaaaatatggtcaaaagccaatcaagggctcaccatacccaagagggtattacaagtgtagcagtgttagaggatgtccagcaaggaagcatgtggagcgtgccgtagatgactcggccatgcttatcgtgacttacgagggggagcaccgtcactcacatactccgttgccgggagacgtcaccgcgagtgctgcaatgcgacacgtgtttcactcaaca

SEQ ID NO: 1583 - protein, 301 aa, Populus trichocarpa
  POPTR_0006s07170.1 polypeptide
MAVDLVRYSKMEDQMAIQEAASAGLESMEHLIFAFSNQTRQSHQLDCGEITNFTVAKFKQVISMLNRTGHARFRRGPTSSPSSYPVPVRPVPQEPQKLNLDFVNSNSPPKAESKNDLSLGSQYSKDSLSSGTTTSSFVSSVTADGSVSNGKQGGSSLFGTQARSTGKPPLSSTHRKKCHDHALSARKISSGGSCHCSKRRKSRVKRTIRVPAVSSKIADIPADEYSWRKYGQKPIKGSPYPRGYYKCSSVRGCPARKHVERAVDDSAMLIVTYEGEHRHSHTPLPGDVTASAAMRHVFHST

SEQ ID NO: 1584 - DNA, 900 bp, Populus trichocarpa
  POPTR_0018s13600.1
atggctgttgatctagttgggtactcaaagatggaagatcagatggctattcaagaagctgcatcagctgggattaagagcatggagcacttgatctttgcactctctaaccaaacccaacaaagtcaccaacttgactgcagagaaatcactagcttcaccgttgctaagttcaagcaagtcatctccatcctgaaccggaccggtcatgcccgtttccgccgtggacccacttcttccaacccggtttccgtccgacctgtcgtccaagaacctcaaaaactaaatcttgatttctttaagagtaacaatacctttaaatctgagaccaaaaacgacttgtcattcggcagtcagtattccaaggattgttttagctctggcacgactacttcgtccttcctgtcttctgttacagctgatgggagtgtctctgatgggaaacaaggtggctcgtcttctcttttcggaactcatcctcgacctaccggaaaaccacctctctcatctatccatcgcaagaaatgccatgatcataccctctccaccagcaagatctcctcctccggtggcagctgccattgctccaaaagaaggaaatcaagggtgaagaggacaataagagtcccagcaataagttccaaagttgctgatataccagcagatgagttctcatggagaaaatatggtcaaaagccaatcaagggttcaccttacccaagagggtactacaagtgtagtagtgtgaggggatgtccagcaaggaagcacgtggagcgtgccgtagatgatccggccatgcttattgtaacatacgaaggggagcaccgtcactcacatgctcccctaccagaaaatgtcacagccaacgctgccatgcgacacgtgttccagtcaaca

SEQ ID NO: 1585 - protein, 300 aa, Populus trichocarpa
  POPTR_0018s13600.1 polypeptide
MAVDLVGYSKMEDQMAIQEAASAGIKSMEHLIFALSNQTQQSHQLDCREITSFTVAKFKQVISILNRTGHARFRRGPTSSNPVSVRPVVQEPQKLNLDFFKSNNTFKSETKNDLSFGSQYSKDCFSSGTTTSSFLSSVTADGSVSDGKQGGSSSLFGTHPRPTGKPPLSSIHRKKCHDHTLSTSKISSSGGSCHCSKRRKSRVKRTIRVPAISSKVADIPADEFSWRKYGQKPIKGSPYPRGYYKCSSVRGCPARKHVERAVDDPAMLIVTYEGEHRHSHAPLPENVTANAAMRHVFQST

SEQ ID NO: 1586 - DNA, 837 bp, Vitis vinifera
  GSVIVT01029265001
atggccgtcgattttctaggattctccaagatggacgagcagatggctatccaggaagccgcatcggccggtttgaagagcatggagcacctgatcctcctcttgaatcatcaccatcctcaatctcagcaaatcaaccacttcgattgcagagaaatcaccgatttcacagtttccaagttcaagcaagtcatttccatcctgaaccggaccggccacgcccggttccgtcgcggtccggttacttcttctccttctcacccatttcattcgaacctgattctatctgcgaagcctgatccgctcaaatcggaaggcaacgctagcgtgtcgtcgacgacttcgtctttcttgtcgtcgatcaccggagacggcagcgtgtcgaacggaaaattagggactcctctgttcgcacctcctccggctccggcggtttccgccggtaaaccgcctctttcgtcgtctcaacggaggaaatgtcatgagcatggatcctccgacaacatctccggaaaactctctgtttccggccgctgccattgctcgaaaagaaggaaaaatcgtgtgaagaggacgatcagagttcctgcgataagctcgaagatcgccgatattcccgccgacgagtactcttggagaaagtacggtcagaagccgatcaagggctcaccatacccacgaggctactacaaatgtagcagcgtgagaggctgcccagcgagaaaacacgtggagcgcgcaccagacgatccggcgatgctcatcgtcacctacgagggagagcaccgccactctcaaactccggcaccggccggtgggctcatgttcccatcaacc

SEQ ID NO: 1587 - protein, 279 aa, Vitis vinifera
  GSVIVT01029265001 polypeptide
MAVDFLGFSKMDEQMAIQEAASAGLKSMEHLILLLNHHHPQSQQINHFDCREITDFTVSKFKQVISILNRTGHARFRRGPVTSSPSHPFHSNLILSAKPDPLKSEGNASVSSTTSSFLSSITGDGSVSNGKLGTPLFAPPPAPAVSAGKPPLSSSQRRKCHEHGSSDNISGKLSVSGRCHCSKRRKNRVKRTIRVPAISSKIADIPADEYSWRKYGQKPIKGSPYPRGYYKCSSVRGCPARKHVERAPDDPAMLIVTYEGEHRHSQTPAPAGGLMFPST

SEQ ID NO: 1588 - DNA, 960 bp, Glycine max
  Glyma17g06450.1
atggcagtagatctggcaaatattaggatggaagagaatatggcgattcaagaagcagcttccgctgggttgaagagtatggagcatctgattcgcgtcctttcttctcaaatcccttctgcttcgtcttcttcttctaacgcacaccaccaccgtcttaatctcaaccaccttgactgcgcggaaatcaccgacttcactgtctccaagttcaaacaagtcatcaacttgttgaatcgcaccggccacgctcgctttcgtcgcgcaccttctcatccttctccttcaatttctccctctcaacctcaacctcagccacaaccacaaccacagacgctgactcttgattttgcaaaacctgttatggtaaagtcaaatcccaaccctaacccttcttctaccgatttgtcggtttctcaatattctaagaccaaggacacaaccacctttagtatatcccctcccatgtccaccaccacttcttccttcctgtcatccatcaccgccgacggcagcgtctctgacggcaagatcggccccgccatcctcgccgccggcaagcctcctctctcctcatcccaccggaaaaggtgtcacgacgccactctctccgccggaaaagcctcttcctccgctcactgccattgctccaagagaaggaaatctcgtgtgaaacgaatgatacgtgtgccggcgataagttcgaagattgccgatatcccagcggacgagtactcgtggagaaagtatggtcaaaaaccaatcaagggatcaccttacccacgagggtattataagtgcagtagcgtgagagggtgtccggcgaggaagcacgtggagcgagcccaggatgaccccaacatgctcatcgttacctacgagggagagcaccgtcatccgcaaccgcgtctgccggaaacttctgccggcgccgccgcggattttgtctctcagcctgtt

SEQ ID NO: 1589 - protein, 320 aa, Glycine max
  Glyma17g06450.1 polypeptide
MAVDLANIRMEENMAIQEAASAGLKSMEHLIRVLSSQIPSASSSSSNAHHHRLNLNHLDCAEITDFTVSKFKQVINLLNRTGHARFRRAPSHPSPSISPSQPQPQPQPQPQTLTLDFAKPVMVKSNPNPNPSSTDLSVSQYSKTKDTTTFSISPPMSTTTSSFLSSITADGSVSDGKIGPAILAAGKPPLSSSHRKRCHDATLSAGKASSSAHCHCSKRRKSRVKRMIRVPAISSKIADIPADEYSWRKYGQKPIKGSPYPRGYYKCSSVRGCPARKHVERAQDDPNMLIVTYEGEHRHPQPRLPETSAGAAADFVSQPV

SEQ ID NO: 1590 - DNA, 534 bp, Arabidopsis thaliana
  G355 (AT2G37430.1 or ZAT11)
atgaagagagaaagatctgatttcgaagaatccctcaagaatattgacattgctaaatgtctgatgatactagcacaaacctccatggtcaaacagatcggtttgaaccaacataccgagagccatacaagcaaccaattcgaatgcaaaacatgtaacaagagattttcttcgtttcaagcccttggtggccaccgggcaagccataagaagccaaagctcaccgttgagcagaaagatgtgaaacatcttagcaacgattataaaggaaatcattttcacaagtgttccatatgcagtcagagttttgggaccggacaggctttaggtggtcacatgagacggcataggtcaagcatgacggtcgagccatcgttcatctctccgatgattccatccatgccggttttgaaacgatgcggtagtagtaagaggattttgagtttggatttgaatctgactccgttagagaatgatcttgaatatatctttgggaagacatttgtcccaaaaatagatatgaagttcgttctt

SEQ ID NO: 1591 - protein, 178 aa, Arabidopsis thaliana
  G355 (AT2G37430.1 or ZAT11), Z- C2H2 domains 47-72, 93-118
MKRERSDFEESLKNIDIAKCLMILAQTSMVKQIGLNQHTESHTSNQFECKTCNKRFSSFQALGGHRASHKKPKLTVEQKDVKHLSNDYKGNHFHKCSICSQSFGTGQALGGHMRRHRSSMTVEPSFISPMIPSMPVLKRCGSSKRILSLDLNLTPLENDLEYIFGKTFVPKIDMKFVL

SEQ ID NO: 1592 - DNA, 525 bp, Arabidopsis thaliana
  AT3G53600.1
atgaagagagaccggtccgattacgaagaatccatgaagcatatagacatagtagaaagtctaatgatgttatctcgaagtttcgtggtcaaacaaatcgatgtaaagcaatctaccggaagcaaaacgaaccataataaccacttcgaatgcaaaacgtgtaaccggaaatttgattccttccaagctcttggaggtcatagagctagccacaagaaacctaagctgatcgttgaccaagaacaggtgaagcatcgtaacaaagagaatgatatgcataagtgtacaatttgcgatcaaatgtttgggaccggtcaagctctaggcggtcacatgagaaagcataggacgagcatgataaccgagcaatcgattgtcccttctgtggtttattccagaccggtttttaatcgttgcagtagcagcaaggagatcttggacttaaatctaactccattggaaaatgatcttgtgttaatctttgggaagaatttggttccacaaattgatttgaagtttgtgaat

SEQ ID NO: 1593 - protein, 175 aa, Arabidopsis thaliana
  AT3G53600.1, Z- C2H2 domains 49-74, 92-117
MKRDRSDYEESMKHIDIVESLMMLSRSFVVKQIDVKQSTGSKTNHNNHFECKTCNRKFDSFQALGGHRASHKKPKLIVDQEQVKHRNKENDMHKCTICDQMFGTGQALGGHMRKHRTSMITEQSIVPSVVYSRPVFNRCSSSKEILDLNLTPLENDLVLIFGKNLVPQIDLKFVN

SEQ ID NO: 1594 - DNA, 519 bp, Glycine max
  Glyma03g33050.1
atgaagagacagagagatttcgaggggtttgagagcatagatttggcaaattgtctaatgatgctctctcatccccaacaaaataagaaactacttcaaacaaaaattgaggctgtgaaatttgagtgcaagacatgcaaccgcaaattctcttcctttcaagcattgggtggccatagggctagccacaaaaggtcgaaacttgagggagatgaactcaaagcacatgctatatctctaagtttgggaaacaaacccaaaatgcacgagtgttccatttgtggacaagaattctcattgggacaagcacttgggggtcacatgagaaggcacaggacaaccattaacgaagatttttcttcaataaaacaggttattacacaagtacctgatttgaaaagatcgaatagcacgagggtgattatgtgcttggacttgaacctaacgccgtttgagaacgacttgaagttgttgtttggaaagatggcaccgaattctggtgccttagttgattcttta

SEQ ID NO: 1595 - protein, 173 aa, Glycine max
  Glyma03g33050.1, Z- C2H2 domains 41-66, 88-113
MKRQRDFEGFESIDLANCLMMLSHPQQNKKLLQTKIEAVKFECKTCNRKFSSFQALGGHRASHKRSKLEGDELKAHAISLSLGNKPKMHECSICGQEFSLGQALGGHMRRHRTTINEDFSSIKQVITQVPDLKRSNSTRVIMCLDLNLTPFENDLKLLFGKMAPNSGALVDSL

SEQ ID NO: 1596 - DNA, 513 bp, Glycine max
  Glyma19g35740.1
atgaagagacagagagatttcaaggggtttgagagcatagatttggcaaattgtctaatgatgctctctcatccccaacaaaatgagaaactacttcaaaaaaaaattgaggctgtggaatttgagtgcaagacatgcaaccgcaaattctcttcctttcaagcattgggtggccatagggctagccacaaaaggtcgaaacttgagggagatcatgaactcaaagcacatgctatatctctaagtttggcaaacaaacccaaaatgcacgagtgttccatttgtggacaagaattctcattgggacaagcacttgggggtcacatgagaaggcacagaacaaccatccacgaagatttttcttcaataaaacaggttattacacaaatgcctgttttgaaaagatcgaatagcacgagggtggttacgtgcttggacttgaacctaacaccgcttgagaacgacttgaagttgttgtttggaaagatggcaccgaatgctggtgcctttgcc

SEQ ID NO: 1597 - protein, 171 aa, Glycine max
  Glyma19g35740.1, Z- C2H2 domains 41-66, 89-114
MKRQRDFKGFESIDLANCLMMLSHPQQNEKLLQKKIEAVEFECKTCNRKFSSFQALGGHRASHKRSKLEGDHELKAHAISLSLANKPKMHECSICGQEFSLGQALGGHMRRHRTTIHEDFSSIKQVITQMPVLKRSNSTRVVTCLDLNLTPLENDLKLLFGKMAPNAGAFA

SEQ ID NO: 1598 - DNA, 474 bp, Glycine max
  Glyma10g05180.1
atgaagagacagagagatggagtagagagcatagatttagtaaattgtctaatgttgctctctcatcacagagaaatcaaaccccaaaaacttctgggccctgaagaatttgagtgtatgacatgcaaccggaagttcacttcgtttcaggccctcggaggccatagggcaagccacaaaaagcccaaattacacgtaaaagaacagggcaaaattctgatgttggggaataagcccaaaaaacacgaatgcaccatttgtggtagggaattcactttgggccaggcacttggaggacacatgaaaaaacacagaattgccgttgaccaagggttttctttgataaacgaggttgttgtaaaagtaccgtttcttaaaaggtctaatagtaagagggttttgttcttggacttgaacttgaacttgactcctctgcagaatgacttgaagttattatttggagaaaaggcaccc

SEQ ID NO: 1599 - protein, 159 aa, Glycine max
  Glyma10g05180.1, Z- C2H2 domains 37-62, 81-106
MKRQRDGVESIDLVNCLMLLSHHREIKPQKLLGPEEFECMTCNRKFTSFQALGGHRASHKKPKLHVKEQGKILMLGNKPKKHECTICGREFTLGQALGGHMKKHRIAVDQGFSLINEVVVKVPFLKRSNSKRVLFLDLNLNLTPLQNDLKLLFGEKAPK

SEQ ID NO: 1600 - DNA, 504 bp, Glycine max
  Glyma13g19550.1
acgagagatggagaagagaacatagatttgggaaattgtctactgttgctctctcatcccagagaaatcaaaccccaaaaacttttgggccctaaagaatttgagtgtatgacatgcaacctcaaattttcttcatttcaggccctcggtggccacagggccagccacaaaaagcccaaactatacgtgaaagaacagtgtaaaattctgatgttgaggaataagcccaaaaaacacgagtgctccatttgtggtagggaattcactttgggccaggcactgggtggacacatgaaaaagcacagaattgccgttgaccaagggctttcttcaataaacaaggttgttgtaaaagtaccggttcttaaaaggtcgaatagtaagagggttttgtgcttggacttgaacttgactcctctgcagaatgacttgaagttattgtttggagacaaggcacccaaaaaaaataaatctattttttaccataataaaaatgcttcttca

SEQ ID NO: 1601 - protein, 168 aa, Glycine max
  Glyma13g19550.1, Z- C2H2 domains 34-59, 78-103
TRDGEENIDLGNCLLLLSHPREIKPQKLLGPKEFECMTCNLKFSSFQALGGHRASHKKPKLYVKEQCKILMLRNKPKKHECSICGREFTLGQALGGHMKKHRIAVDQGLSSINKVVVKVPVLKRSNSKRVLCLDLNLTPLQNDLKLLFGDKAPKKNKSIFYHNKNASS

SEQ ID NO: 1602 - DNA, 537 bp, Glycine max
  Glyma10g05210.1
atggtagcaattctcaagagacagggagaaaacgaatccgaagaaaccatcataggcttggcaaaaagtctcatgcaactctcgcgtgtccaacaacaaagcaataagcctcttctcaaaaccttttctccaacggagttcgagtgcaaaacctgtaaccgcaagttttcatcttttcaagctcttggtggccacagggctagccacaagaagcccaagttcgaagctgaagaactcaaagaagaagccaagaagactaaacccaaaatgcacgagtgttcaatttgtggcatggaattctctctgggccaggcactggggggtcacatgagaaaacacagaggtgccattagtgagaacgacaataataatgaagcgttgtcttctataaagcaagcaattgcaaaagctccggttttgaaacgatcgaatagcaagagggtcatgtgcttggagatggacctgaatttgacgcctttggagaatgacttgaagttgttgttcggaaacaaggctcctagagtcgatctttctttg

SEQ ID NO: 1603 - protein, 179 aa, Glycine max
  Glyma10g05210.1, Z- C2H2 domains 47-72, 90-115
MVAILKRQGENESEETIIGLAKSLMQLSRVQQQSNKPLLKTFSPTEFECKTCNRKFSSFQALGGHRASHKKPKFEAEELKEEAKKTKPKMHECSICGMEFSLGQALGGHMRKHRGAISENDNNNEALSSIKQAIAKAPVLKRSNSKRVMCLEMDLNLTPLENDLKLLFGNKAPRVDLSL

SEQ ID NO: 1604 - DNA, 546 bp, Glycine max
  Glyma13g19570.1
atggtagccattctgaagagacaaagagaaaccgaagccgaggagagcatcataagactggcagaaagtctcatgcaactgtcgcgagtccaacaaaaaagcaagcctcttctcaaaaccttttctccaacggagttcgagtgcaaaacctgtaaccgcaagtttccatcttttcaagcccttggtggtcacagggcgagccacaagaagcccaagttcgaaggtgaagaactcaaagaggaggccaagaagggtctgagtttggggaacaaacccaaaatgcacgagtgttccatttgcggcatggaattctctctgggtcaggcactggggggtcacatgagaaaacacaggggtgccaccagtgagaataataacgaagcgttttcttcttctataaagcaagcaatttcaaaagttccagttttgaaacgatcgaatagcaagagggtcatgtgcttggagatggacctgaatttaacgcctttggaaaatgacttgaagttgttgttcggaaacaaggctcctagagtcgatctttctttg

SEQ ID NO: 1605 - protein, 182 aa, Glycine max
  Glyma13g19570.1, Z- C2H2 domains 46-71, 94-119
MVAILKRQRETEAEESIIRLAESLMQLSRVQQKSKPLLKTFSPTEFECKTCNRKFPSFQALGGHRASHKKPKFEGEELKEEAKKGLSLGNKPKMHECSICGMEFSLGQALGGHMRKHRGATSENNNEAFSSSIKQAISKVPVLKRSNSKRVMCLEMDLNLTPLENDLKLLFGNKAPRVDLSL

SEQ ID NO: 1606 - DNA, 537 bp, Glycine max
  Glyma10g05190.1
atgaagagacatagagagaatgaaggaacaacattagaaagctggggcatgcaaaattgttcaatttcaatcacacccgacacaacaagtgtttcaagttccaccacttcccctgaagaagtatttgagtgcaaaacgtgcaaccgcaagttcaactcttttcaagcactgggtggccacagggctagtcacaacaagagggtggagatggaaggtgaagaacaacaactcaaactcaaaaacaagggcaaaatctatgggttgggaaaacaaagtgagcccaaaattcataattgcttcatttgtggtcagggtttttctctgggccaggccttgggaggacacatgagaagacacagagatgcaaccaacgatgttttctcgtccataaaccaggttgttgctaaagtttcagttctcaagagatcgtgtaatggcaaggttttctgcttggacctcaacttaagtcctctcgagaatgacttgaagttattgctgttcgggaaagtgtcacccaaagttaatccttcttccttc

SEQ ID NO: 1607 - protein, 179 aa, Glycine max
  Glyma10g05190.1, Z- C2H2 domains 42-67, 96-121
MKRHRENEGTTLESWGMQNCSISITPDTTSVSSSTTSPEEVFECKTCNRKFNSFQALGGHRASHNKRVEMEGEEQQLKLKNKGKIYGLGKQSEPKIHNCFICGQGFSLGQALGGHMRRHRDATNDVFSSINQVVAKVSVLKRSCNGKVFCLDLNLSPLENDLKLLLFGKVSPKVNPSSF

SEQ ID NO: 1608 - DNA, 528 bp, Glycine max
  Glyma13g19560.1
atgaagagacagagagagaacgaagtaacaacgttggaaagctgggacatgcaaatttgttcaacttcaatcacacccgacacaagtgtttccagttccaccatatctccggaagatgtatttgagtgcaaaacgtgcaaccgcaagttcaactcttttcaagcgctgggtggccatagggcttgtcacaacaagagggtgaagatggaaggtgaagaacaacaactcaaaacaagggcaaaatatctgggtttgggaaaacacagtgagcccaaaatgcataattgctccatttgtggtcaaggtttctctctgggccaggccttgggaggacacatgagaagacacagagcttcgaccaacgatgttttctcttccataaaccaggttgttgcaaaagtttcggttttaaaaagatcgtgtaatgacaaggttttctacttggacctcaacttaactcccctcgagaatgacttgaaattgttgttgttcgggaaattgtcacccaaagttaatctttcttccttc

SEQ ID NO: 1609 - protein, 176 aa, Glycine max
  Glyma13g19560.1, Z- C2H2 domains 41-66, 93-118
MKRQRENEVTTLESWDMQICSTSITPDTSVSSSTISPEDVFECKTCNRKFNSFQALGGHRACHNKRVKMEGEEQQLKTRAKYLGLGKHSEPKMHNCSICGQGFSLGQALGGHMRRHRASTNDVFSSINQVVAKVSVLKRSCNDKVFYLDLNLTPLENDLKLLLFGKLSPKVNLSSF

SEQ ID NO: 1610 - DNA, 516 bp, Citrus clementina
  clementine0.9_035547m
atggccgtgaagggaggtttagcaaatggagaaatagcggagagattagcactggctaactgtttgatgttgcttacacgtagcaatagagcaaagctgccaattaagaagcgtttggcgagcgacgtatttgagtgcaagacttgtaatcgccagttcccatcatttcaagccctaggaggccacagagccagccacaagaagccaagactaatcaatggcgagaccaaaacgttgagctcgacgacggcgacgaagccgaagctgcatgaatgctcaatatgtgggcaggaatttgctatggggcaggccttgggcggtcacatgagaaggcacaggatcgccatgaatgaaagcttgaattctgccgtgatcgtttcgcagtcgccgccggtgttaaggagatcgaatagcagcagaagggtttttggattggatttgaacttgactccattagagaatgatttggaggctttgtttgggaagatggttcctaaggttgatctattaatgact

SEQ ID NO: 1611 - protein, 172 aa, Citrus clementina
  clementine0.9_035547m, Z- C2H2 domains 44-69, 89-114
MAVKGGLANGEIAERLALANCLMLLTRSNRAKLPIKKRLASDVFECKTCNRQFPSFQALGGHRASHKKPRLINGETKTLSSTTATKPKLHECSICGQEFAMGQALGGHMRRHRIAMNESLNSAVIVSQSPPVLRRSNSSRRVFGLDLNLTPLENDLEALFGKMVPKVDLLMT

SEQ ID NO: 1612 - DNA, 531 bp, Eucalyptus grandis
  Eucgr.A01230.1
atgaaaagaaccagagatgactatgaacggatgagcttggacatggcgaaatgcctaatgcttctctcccacggggtcaacgcagagctcaaaagagccgctgtgcatcaaaccgaggacaactacgagtgcaagacgtgcaatcgccagttctcttcattccaggcgcttggcggccaccgggcgagccacaagaagccgaagttgctgcagaacaagccgggagactgcaccaagttggcgttgggagggacagcggagaccaagatgcatgagtgctcggtatgtgggctgaagttcgcgttggggcaagccttgggcggccacatgaggaagcacagggccgagttaatgagtgggaacatgatgaatatggacgaatttttcgggattaattcgacggtcccggtgttgaacaggtcgaatagcagcagtaagagggttatgggcctggacttgaacttgactcctcttgagaatgacctcaagttcttgtttggcaagatgtatccacggacggtcgctttctct

SEQ ID NO: 1613 - protein, 177 aa, Eucalyptus grandis
  Eucgr.A01230.1, Z- C2H2 domains 42-67, 90-115
MKRTRDDYERMSLDMAKCLMLLSHGVNAELKRAAVHQTEDNYECKTCNRQFSSFQALGGHRASHKKPKLLQNKPGDCTKLALGGTAETKMHECSVCGLKFALGQALGGHMRKHRAELMSGNMMNMDEFFGINSTVPVLNRSNSSSKRVMGLDLNLTPLENDLKFLFGKMYPRTVAFS

SEQ ID NO: 1614 - DNA, 492 bp, Eucalyptus grandis
  Eucgr.A01231.1
atggcgaaatgcctgatgcttctctcccacggggtcaacacaaaccctaaaaaagccgccgtgcatcacgatgaggacaacttcgagtgcaagacgtgcaaccgccggttctcgtcattccaggcacttggcggccaccgggcgagccacaagaagccaaggctgctggagacaacgaagctggaagactgcaccaagctggcgttgggctcaatggcaaagccgaagatgcacgagtgctcgatgtgcgggctgaagttcgcatcggggcaagccttgggaggccacatgaggagacacagggccgagctgatgagcggggacatgatgaagatggacgagattctcgctgtcggttcgatgatccctctgttgaagaggtcgaatagcagcaagagggttatgggcctggacttgaacttgtctcctcttgagaatgatctcaagttcttgtttggcaagatggctcccaagatagatccagtgttcctg

SEQ ID NO: 1615 - protein, 164 aa, Eucalyptus grandis
  Eucgr.A01231.1, Z- C2H2 domains 28-53, 77-102
MAKCLMLLSHGVNTNPKKAAVHHDEDNFECKTCNRRFSSFQALGGHRASHKKPRLLETTKLEDCTKLALGSMAKPKMHECSMCGLKFASGQALGGHMRRHRAELMSGDMMKMDEILAVGSMIPLLKRSNSSKRVMGLDLNLSPLENDLKFLFGKMAPKIDPVFL

SEQ ID NO: 1616 - DNA, 543 bp, Eucalyptus grandis
  Eucgr.A01232.1
atgatgaaaagaagcagagatgactatgaaaggatgaacttggacatggcgaaatgcctaatgctactcacccatggcgtcaacgcaaacccaaagacagccgctgtgcatcaccatgaagacaacttcaagtgcaagacgtgcaatcgccagttcccttcattccaggcgcttggtggccaccgggcaagccacaagaagccgaagctgctggagacaaagccagaagacagcaccaagtcagtgttgggcacgacggcaaatcccaagatgcacgagtgctcgatatgcgggctgaagttctcattggggcaagccttgggaggccacatgaggaggcacagggtgcagttgatgagcgggagcgggagcgtgatgaagatggatgagattttcgtggttggtccgacaatcccagtgttgaagaggtcgaaaagcagcaataagagggttatgggcctcgacttgaacttgactcctcttgagaatgacctcaagttcttatttggcaagatggctccggagatagatgccttgctcctg

SEQ ID NO: 1617 - protein, 181 aa, Eucalyptus grandis
  Eucgr.A01232.1, Z- C2H2 domains 43-68, 91-116
MMKRSRDDYERMNLDMAKCLMLLTHGVNANPKTAAVHHHEDNFKCKTCNRQFPSFQALGGHRASHKKPKLLETKPEDSTKSVLGTTANPKMHECSICGLKFSLGQALGGHMRRHRVQLMSGSGSVMKMDEIFVVGPTIPVLKRSKSSNKRVMGLDLNLTPLENDLKFLFGKMAPEIDALLL

SEQ ID NO: 1618 - protein, 26 aa, Arabidopsis thaliana
  AT2G37430.1, amino acids 47-72, 1st Z-C2H2 domain
FECKTCNKRFSSFQALGGHRASHKKP

SEQ ID NO: 1619 - protein, 26 aa, Arabidopsis thaliana
  AT3G53600.1, amino acids 49-74, 1st Z-C2H2 domain
FECKTCNRKFDSFQALGGHRASHKKP

SEQ ID NO: 1620 - protein, 26 aa, Glycine max
  Glyma03g33050.1, amino acids 41-66, 1st Z-C2H2 domain
FECKTCNRKFSSFQALGGHRASHKRS

SEQ ID NO: 1621 - protein, 26 aa, Glycine max
  Glyma19g35740.1, amino acids 41-66, 1st Z-C2H2 domain
FECKTCNRKFSSFQALGGHRASHKRS

SEQ ID NO: 1622 - protein, 26 aa, Glycine max
  Glyma10g05180.1, amino acids 37-62, 1st Z-C2H2 domain
FECMTCNRKFTSFQALGGHRASHKKP

SEQ ID NO: 1623 - protein, 26 aa, Glycine max
  Glyma13g19550.1, amino acids 34-59, 1st Z-C2H2 domain
FECMTCNLKFSSFQALGGHRASHKKP

SEQ ID NO: 1624 - protein, 26 aa, Glycine max
  Glyma10g05210.1, amino acids 47-72, 1st Z-C2H2 domain
FECKTCNRKFSSFQALGGHRASHKKP

SEQ ID NO: 1625 - protein, 26 aa, Glycine max
  Glyma13g19570.1, amino acids 46-71, 1st Z-C2H2 domain
FECKTCNRKFPSFQALGGHRASHKKP

SEQ ID NO: 1626 - protein, 26 aa, Glycine max
  Glyma10g05190.1, amino acids 42-67, 1st Z-C2H2 domain
FECKTCNRKFNSFQALGGHRASHNKR

SEQ ID NO: 1627 - protein, 26 aa, Glycine max
  Glyma13g19560.1, amino acids 41-66, 1st Z-C2H2 domain
FECKTCNRKFNSFQALGGHRACHNKR

SEQ ID NO: 1628 - protein, 26 aa, Citrus clementina
  clementine0.9_035547m, amino acids 44-69, 1st Z-C2H2 domain
FECKTCNRQFPSFQALGGHRASHKKP

SEQ ID NO: 1629 - protein, 26 aa, Eucalyptus grandis
  Eucgr.A01230.1, amino acids 42-67, 1st Z-C2H2 domain
YECKTCNRQFSSFQALGGHRASHKKP

SEQ ID NO: 1630 - protein, 26 aa, Eucalyptus grandis
  Eucgr.A01231.1, amino acids 28-53, 1st Z-C2H2 domain
FECKTCNRRFSSFQALGGHRASHKKP

SEQ ID NO: 1631 - protein, 26 aa, Eucalyptus grandis
  Eucgr.A01232.1, amino acids 43-68, 1st Z-C2H2 domain
FKCKTCNRQFPSFQALGGHRASHKKP

SEQ ID NO: 1632 - protein, 26 aa, Arabidopsis thaliana
  AT2G37430.1, amino acids 93-118, 2nd Z-C2H2 domain
FHKCSICSQSFGTGQALGGHMRRHRS

SEQ ID NO: 1633 - protein, 26 aa, Arabidopsis thaliana
  AT3G53600.1, amino acids 92-117, 2nd Z-C2H2 domain
MHKCTICDQMFGTGQALGGHMRKHRT

SEQ ID NO: 1634 - protein, 26 aa, Glycine max
  Glyma03g33050.1, amino acids 88-113, 2nd Z-C2H2 domain
MHECSICGQEFSLGQALGGHMRRHRT

SEQ ID NO: 1635 - protein, 26 aa, Glycine max
  Glyma19g35740.1, amino acids 89-114, 2nd Z-C2H2 domain
MHECSICGQEFSLGQALGGHMRRHRT

SEQ ID NO: 1636 - protein, 26 aa, Glycine max
  Glyma10g05180.1, amino acids 81-106, 2nd Z-C2H2 domain
KHECTICGREFTLGQALGGHMKKHRI

SEQ ID NO: 1637 - protein, 26 aa, Glycine max
  Glyma13g19550.1, amino acids 78-103, 2nd Z-C2H2 domain
KHECSICGREFTLGQALGGHMKKHRI

SEQ ID NO: 1638 - protein, 26 aa, Glycine max
  Glyma10g05210.1, amino acids 90-115, 2nd Z-C2H2 domain
MHECSICGMEFSLGQALGGHMRKHRG

SEQ ID NO: 1639 - protein, 26 aa, Glycine max
  Glyma13g19570.1, amino acids 94-119, 2nd Z-C2H2 domain
MHECSICGMEFSLGQALGGHMRKHRG

SEQ ID NO: 1640 - protein, 26 aa, Glycine max
  Glyma10g05190.1, amino acids 96-121, 2nd Z-C2H2 domain
IHNCFICGQGFSLGQALGGHMRRHRD

SEQ ID NO: 1641 - protein, 26 aa, Glycine max
  Glyma13g19560.1, amino acids 93-118, 2nd Z-C2H2 domain
MHNCSICGQGFSLGQALGGHMRRHRA

SEQ ID NO: 1642 - protein, 26 aa, Citrus clementina
  clementine0.9_035547m, amino acids 89-114, 2nd Z-C2H2 domain
LHECSICGQEFAMGQALGGHMRRHRI

SEQ ID NO: 1643 - protein, 26 aa, Eucalyptus grandis
  Eucgr.A01230.1, amino acids 90-115, 2nd Z-C2H2 domain
MHECSVCGLKFALGQALGGHMRKHRA

SEQ ID NO: 1644 - protein, 26 aa, Eucalyptus grandis
  Eucgr.A01231.1, amino acids 77-102, 2nd Z-C2H2 domain
MHECSMCGLKFASGQALGGHMRRHRA

SEQ ID NO: 1645 - protein, 26 aa, Eucalyptus grandis
  Eucgr.A01232.1, amino acids 91-116, 2nd Z-C2H2 domain
MHECSICGLKFSLGQALGGHMRRHRV

SEQ ID NO: 1646 - protein, 26 aa, Arabidopsis thaliana
  misc_feature (1)..(2): Xaa can be any naturally occurring amino acid
  misc_feature (4)..(4): Xaa can be any naturally occurring amino acid
  misc_feature (8)..(9): Xaa can be any naturally occurring amino acid
  misc_feature (11)..(11): Xaa can be any naturally occurring amino acid
  misc_feature (22)..(22): Xaa can be any naturally occurring amino acid
  misc_feature (24)..(26): Xaa can be any naturally occurring amino acid
  ZAT11 clade consensus Z-C2H2-1 sequence
XXCXTCNXXFXSFQALGGHRAXHXXX

SEQ ID NO: 1647 - protein, 24 aa, Arabidopsis thaliana
  misc_feature (2)..(2): Xaa can be any naturally occurring amino acid
  misc_feature (4)..(5): Xaa can be any naturally occurring amino acid
  misc_feature (7)..(9): Xaa can be any naturally occurring amino acid
  misc_feature (11)..(12): Xaa can be any naturally occurring amino acid
  misc_feature (21)..(22): Xaa can be any naturally occurring amino acid
  ZAT11 clade consensus Z-C2H2-2 sequence
HXCXXCXXXFXXGQALGGHMXXHR

SEQ ID NO: 1648 - protein, 20 aa, Arabidopsis thaliana
  misc_feature (2)..(4): Xaa can be any naturally occurring amino acid
  misc_feature (8)..(8): Xaa can be any naturally occurring amino acid
  misc_feature (10)..(11): Xaa can be any naturally occurring amino acid
  misc_feature (15)..(18): Xaa can be any naturally occurring amino acid
  ZAT11 clade consensus sequence near c-terminus
LXXXLNLXPXXNDLXXXXFG

SEQ ID NO: 1649 - DNA, 468 bp, Arabidopsis thaliana
  AT2G28710.1
atggaaaggggaagatcagatatggagatgataaacaacatggcaaattgcttgattcttctatcaaaggcccatcaaaacgacaccaaaagccgtgttttcgcgtgcaagacatgcaacaaagagttcccgtcgttccaagccttgggaggtcaccgagccagccaccggcgatccgcagcgcttgaaggccacgcacctccttctcctaagagagtcaaaccggtgaaacacgagtgtcccatatgtggtgctgagttcgcggtagggcaggccttaggtggtcacatgaggaagcatagaggtggatcaggaggaggaggtggccggagtttggcgccggctacagcgccggtgacgatgaagaaatcaggcggtggtaatggaaaaagagttttgtgtttggacttgaacttgacgcctttagagaacgaagatttgaagttggagcttgggaggtttattttc

SEQ ID NO: 1650 - protein, 156 aa, Arabidopsis thaliana
  AT2G28710.1
MERGRSDMEMINNMANCLILLSKAHQNDTKSRVFACKTCNKEFPSFQALGGHRASHRRSAALEGHAPPSPKRVKPVKHECPICGAEFAVGQALGGHMRKHRGGSGGGGGRSLAPATAPVTMKKSGGGNGKRVLCLDLNLTPLENEDLKLELGRFIF

SEQ ID NO: 1651 - DNA, 510 bp, Arabidopsis thaliana
  AT3G46070.1
atggttgctgaaagtgataatcgtgatctgacggtggatacggcggcgagctgtctgatgttgttatcaggaattggagaacacgacggaagaaagaaacgtgttttccgatgcaagacttgtgagagagacttcgattcgttccaagctttaggaggccaccgtgcaagccactcgaaactaaccaacagtgacgataaatcacttcctggatcaccaaagaagaagcctaaaactacgactacgacgacggctcatacttgtccgatttgtggcttggagtttccgatgggacaagctcttggtggtcacatgaggaaacataggaacgagaaagaacgagaaaaggcttctaacgtattggttacgcattctttcatgccggagacgacaacggtgacgactttgaagaaatcgagtagtgggaagagagtggcgtgtttggatttcgacttaacttcggtggagagctttgtcaacacggaattggagttgggaagaacgatgtac

SEQ ID NO: 1652 - protein, 170 aa, Arabidopsis thaliana
  AT3G46070.1
MVAESDNRDLTVDTAASCLMLLSGIGEHDGRKKRVFRCKTCERDFDSFQALGGHRASHSKLTNSDDKSLPGSPKKKPKTTTTTTAHTCPICGLEFPMGQALGGHMRKHRNEKEREKASNVLVTHSFMPETTTVTTLKKSSSGKRVACLDFDLTSVESFVNTELELGRTMY

SEQ ID NO: 1653 - DNA, 492 bp, Arabidopsis thaliana
  AT3G46080.1
atggttgcgagaagtgaggaagttgagatagtggaagatacggcggcgaaatgtttgatgttgttatcaagagttggagaatgcggcggaggaggagagaaacgagttttccgatgcaagacttgtcttaaagagttttcgtcgtttcaagctttgggaggtcatcgtgcaagccacaagaaactcattaacagtagcgatccatcacttcttggatccttgtctaacaagaaaactaaaacggcgacgtctcatccttgtccgatatgtggcgtggagtttccgatggggcaagctcttggtggtcacatgaggagacataggagtgagaaagcctcaccaggcacgttggttacacgttcttttttaccggagacgacgacggtgacgactttgaaaaaatcgagtagtgggaagagagtggcttgtttggacttagattcgatggagagtttagtcaattggaagttggagttgggaagaacgatttct

SEQ ID NO: 1654 - protein, 164 aa, Arabidopsis thaliana
  AT3G46080.1
MVARSEEVEIVEDTAAKCLMLLSRVGECGGGGEKRVFRCKTCLKEFSSFQALGGHRASHKKLINSSDPSLLGSLSNKKTKTATSHPCPICGVEFPMGQALGGHMRRHRSEKASPGTLVTRSFLPETTTVTTLKKSSSGKRVACLDLDSMESLVNWKLELGRTIS

SEQ ID NO: 1655 - DNA, 504 bp, Arabidopsis thaliana
  AT3G46090.1
atggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaaaactaaaacgtctcatccttgtccgatatgtggagtgaagtttccgatgggacaagctcttggtggtcacatgaggagacataggaacgagaaagtctcaggctcgttggttacacgttcttttctaccggagacgacgacggtgacggctttgaagaaatttagtagtgggaagagagtggcttgtttggatttggacttagattcgatggagagtttggtcaattggaagttggagttgggaagaacgatttcttggagt

SEQ ID NO: 1656 - protein, 168 aa, Arabidopsis thaliana
  AT3G46090.1
MVARSEEIVIVEEDTTAKCLMLLSRVGECGGGCGGDERVFRCKTCLKEFSSFQALGGHRASHKKLINSDNPSLLGSLSNKKTKTSHPCPICGVKFPMGQALGGHMRRHRNEKVSGSLVTRSFLPETTTVTALKKFSSGKRVACLDLDLDSMESLVNWKLELGRTISWS

SEQ ID NO: 1657 - DNA, 486 bp, Arabidopsis thaliana
  AT5G59820.1
atggttgcgatatcggagatcaagtcgacggtggatgtcacggcggcgaattgtttgatgcttttatctagagttggacaagaaaacgttgacggtggcgatcaaaaacgcgttttcacatgtaaaacgtgtttgaagcagtttcattcgttccaagccttaggaggtcaccgtgcgagtcacaagaagcctaacaacgacgctttgtcgtctggattgatgaagaaggtgaaaacgtcgtcgcatccttgtcccatatgtggagtggagtttccgatgggacaagctttgggaggacacatgaggagacacaggaacgagagtggggctgctggtggcgcgttggttacacgcgctttgttgccggagcccacggtgactacgttgaagaaatctagcagtgggaagagagtggcttgtttggatctgagtctagggatggtggacaatttgaatctcaagttggagcttggaagaacagtttat

SEQ ID NO: 1658 - protein, 162 aa, Arabidopsis thaliana
  AT5G59820.1
MVAISEIKSTVDVTAANCLMLLSRVGQENVDGGDQKRVFTCKTCLKQFHSFQALGGHRASHKKPNNDALSSGLMKKVKTSSHPCPICGVEFPMGQALGGHMRRHRNESGAAGGALVTRALLPEPTVTTLKKSSSGKRVACLDLSLGMVDNLNLKLELGRTVY

SEQ ID NO: 1659 - DNA, 516 bp, Glycine max
  Glyma15g04570.1
atgaagagaggcagagaagagagtaagttagacatggctaattgcttgatgctattgacgaaagttggagagagtgaaaccaattacccaatatcaaagggtagtgatattggtgatttcaagtgcaagacttgcaatagaaggttctcttcttttcaagcccttggtggccatagagcaagccacaaaaaaccaaagctcatggtcacagatctttcgtgccatcaagagttaccgaacccaaccatgaaacaacaacctaggatgcacccgtgtccgatttgtgggcttgagtttgctattggacaagctttgggagggcacatgagaaagcatagaactgctattaatgatggcttgttgtgtggtaaaccttcttcttcgttgtccatcttgaaggaatcatcgaaagatggtgatcaaaagttgaatttgcgcttggacttgaacttgacgccattggaggaggatgatcttaagctcaacctaaggacgcccgtgctcaattgtttcatt

SEQ ID NO: 1660 - protein, 172 aa, Glycine max
  Glyma15g04570.1
MKRGREESKLDMANCLMLLTKVGESETNYPISKGSDIGDFKCKTCNRRFSSFQALGGHRASHKKPKLMVTDLSCHQELPNPTMKQQPRMHPCPICGLEFAIGQALGGHMRKHRTAINDGLLCGKPSSSLSILKESSKDGDQKLNLRLDLNLTPLEEDDLKLNLRTPVLNCFI

SEQ ID NO: 1661 - DNA, 477 bp, Citrus clementina
  clementine0.9_024203m
atgaagagagatagagaaatggcagccattgacaccgcaaattgcttgatgctgctctcaaaagttggcgaaacagaccagggaaagcgtgtatttgcatgcaaaacatgcaacaaagagttcccatcgttccaagctttaggcggccacagagcaagtcacaagaagccgaagctgatgacgatggcttcatcaggggaagattttgatcaagcccagatgccaccagcttcccccaagaagcctaaaacgcacgagtgttcgatttgtggtcttgagtttgctattgggcaagcgctcggcggtcacatgaggagacacagggcagcagctgccatgggcgccgccgccgatggattggtgactcgtcctcttttgcagctccccgttctgaagaaatccaatagttgtaaaagagctttgtgcttggatttgaacttgatgcctactggggatgatttgaagttatgggtcgct

SEQ ID NO: 1662 - protein, 159 aa, Citrus clementina
  clementine0.9_024203m
MKRDREMAAIDTANCLMLLSKVGETDQGKRVFACKTCNKEFPSFQALGGHRASHKKPKLMTMASSGEDFDQAQMPPASPKKPKTHECSICGLEFAIGQALGGHMRRHRAAAAMGAAADGLVTRPLLQLPVLKKSNSCKRALCLDLNLMPTGDDLKLWVA

SEQ ID NO: 1663 - DNA, 534 bp, Eucalyptus grandis
  Eucgr.B02390.1
cttccagagatggtgaagagagacagagaggacacggaggtcgaagccctggccagggtcaattgcttgatgctcctctcccgagttggcgagagcaccgactcggcgtcgccggaccgcaaatcgcggcctaccgagcgaatgttcgcgtgcaagacttgcaaccgcgagttctcctcgttccaggcgctcggagggcacaaagccagccacaagaagccgaagttgatctccggcgatctcttccacctcggccacgcagcagattcctcgccggccaagccgaagacgcacgagtgctcgatatgcggcctcgatttcccgatgggccaagccctcggcggtcacatgaggaggcacagggcggccatgctggaaagcttggcagcagcagccgcaaagcctgtgccagtgttgaagaaatcaaacagcaagagagtcacgggcttggatttgaactcgttgccgatggaggacgacttgaccttgcgtttagggaaggttgcgccgccattggtgctagatctcgttttg

SEQ ID NO: 1664 - protein, 178 aa, Eucalyptus grandis
  Eucgr.B02390.1
LPEMVKRDREDTEVEALARVNCLMLLSRVGESTDSASPDRKSRPTERMFACKTCNREFSSFQALGGHKASHKKPKLISGDLFHLGHAADSSPAKPKTHECSICGLDFPMGQALGGHMRRHRAAMLESLAAAAAKPVPVLKKSNSKRVTGLDLNSLPMEDDLTLRLGKVAPPLVLDLVL

SEQ ID NO: 1665 - DNA, 525 bp, Eucalyptus grandis
  Eucgr.B02392.1
atggtgaagagagacagagaggacacggaggtcgaagccctggccagggccaattgcttgatgctcctctcccgtgttggcgagagcaccgactcggcgtcgctggaccgcaaatcgcaccctacagagcgaatgttcgcgtgcaagacttgcaaccgcgaattctcctcgttccaggccctcggagggcacaaagccagccacaagaagccgaagctgatctccggtgacctcttccacctcggccacgcagcagattcctcgccggccaagccgaagacgcacgagtgctcgatatgcggcctcgatttcccgatgggccaagccctcggcggtcacatgaggaagcacagggcggccatgctggaaagcttggcagcagcggccgcaaagcctgtgccagtgttgaagaaatcaaacagcaagagagtcacgggcttcgatttgaactcgttgccgatgcaggacgacttgaccttgcgtttaggaaaggttgcgccgcctttggtgcttgatctcgttttg

SEQ ID NO: 1666 - protein, 175 aa, Eucalyptus grandis
  Eucgr.B02392.1
MVKRDREDTEVEALARANCLMLLSRVGESTDSASLDRKSHPTERMFACKTCNREFSSFQALGGHKASHKKPKLISGDLFHLGHAADSSPAKPKTHECSICGLDFPMGQALGGHMRKHRAAMLESLAAAAAKPVPVLKKSNSKRVTGFDLNSLPMQDDLTLRLGKVAPPLVLDLVL

SEQ ID NO: 1667 - DNA, 516 bp, Eucalyptus grandis
  Eucgr.B02394.1
atggtgaagagagacagagaggacacggaggtcgaagccctggccgtggccaacagcttgatgctcctctcccgaatcggccggagcaccgactcaaaccgcaaatcgcggcctacagagcggatgttcacatgcaagacgtgcaaccgcgagttcccctcgttccaggcgctcggagggcacagagccagccacaagaagccaaagctgatctccggcgacctcttgcgccttggccgcacggcagattcctcgccggccaagctgaagatgcacgagtgctcgatatgcggcctcgatttcccgactggccaagcccttggtggtcacatgaggcggcacagggcggccatactggagagcttggtggcggccgccgcaaagcctgtgccggtgttgaagaaatcgaacagcaagagagtcaggggcttggatttgaactcgttgccgatggaggacgacttgaccttgcgtttaggaaaggttgcgccgcctttagtgccagatctcgttttg

SEQ ID NO: 1668 - protein, 172 aa, Eucalyptus grandis
  Eucgr.B02394.1
MVKRDREDTEVEALAVANSLMLLSRIGRSTDSNRKSRPTERMFTCKTCNREFPSFQALGGHRASHKKPKLISGDLLRLGRTADSSPAKLKMHECSICGLDFPTGQALGGHMRRHRAAILESLVAAAAKPVPVLKKSNSKRVRGLDLNSLPMEDDLTLRLGKVAPPLVPDLVL

SEQ ID NO: 1669 - DNA, 516 bp, Eucalyptus grandis
  Eucgr.B02396.1
atggtgaagagagacagagaggacatggaggtcgaagccctggccgtggccaacagcttgatgctcctctcccgagttggccagagcaccgactcaaaccgcaaatggcagccaacagagcggatgttcacgtgcaagacgtgcaaccgcgagttctcatccttccaggcgctcggagggcacagagctagccacaagaagccgaagctgatctccggcgacctcttgcgccttggccacgaagcggattcctcgccggccaagccgaagacgcatgagtgcccgatatgtggcctcgatttcccgatcggccaagccctaggtggtcacatgaggaggcacagggccgccatgctggagagcttggcggcggcagccacaaagcccgtgccggtgttgaagaaatcgaacagcaagagagtcacgggcttggatttgaactcgtcgcccatggaggacgacttgaccttgcgtttaggaaaggttgcgccgcctttggtgctagatctcgttttg

SEQ ID NO: 1670 - protein, 172 aa, Eucalyptus grandis
  Eucgr.B02396.1
MVKRDREDMEVEALAVANSLMLLSRVGQSTDSNRKWQPTERMFTCKTCNREFSSFQALGGHRASHKKPKLISGDLLRLGHEADSSPAKPKTHECPICGLDFPIGQALGGHMRRHRAAMLESLAAAATKPVPVLKKSNSKRVTGLDLNSSPMEDDLTLRLGKVAPPLVLDLVL

SEQ ID NO: 1671 - DNA, 516 bp, Eucalyptus grandis
  Eucgr.L02150.1
atggtgaagagagacagagaggacatggaggtcgaagccctggccgtggccaacagcttgatgctcctctcccgagttggccagagcaccgactcgaactgcaaatggcagcctacagagcggatgttcgcgtgcaagacgtgcaaccgcgagttctcatccttccaggcgctgggagggcacagagccagccacaagaagccgaagctgatctccggcgacctcttgcgccttggccacgaagcggattcctcgccagccaagccgaagacgcatgagtgcccgatatgtggcctcgatttcccgatcggccaagccctaggtggtcacatgaggaggcacagggccgccatgctggagagcttggcggcggcagccacaaagcccgtgccggtgttgaagaaatcgaacagcaagagagtcacgggcttggatttgaactcgtcgcccatggaggacgacttgaccttgcgtttaggaaaggttgcgccgcctttggtgctagatctcgttttg

SEQ ID NO: 1672 - protein, 172 aa, Eucalyptus grandis
  Eucgr.L02150.1
MVKRDREDMEVEALAVANSLMLLSRVGQSTDSNCKWQPTERMFACKTCNREFSSFQALGGHRASHKKPKLISGDLLRLGHEADSSPAKPKTHECPICGLDFPIGQALGGHMRRHRAAMLESLAAAATKPVPVLKKSNSKRVTGLDLNSSPMEDDLTLRLGKVAPPLVLDLVL

SEQ ID NO: 1673 - DNA, 582 bp, Eucalyptus grandis
  Eucgr.B02395.1
agcaaaagaagaaaccagaaaaatcagacgcttcaatttcacattctctactacagaattccagagatggtgaagagagacagagaggacacggaggtcgaggccctggccgtggccaacagcttgatgctcctctcccgagtcggccagagcagcgactcgaactgcaaatcgtggcctacagagcggatgttcgcgtgcaagacgtgcaaccgcgagttctcctccttccaggcgctgggagggcacagagccagccacaagaagccgaagctgatctccggcgacctcttccacctcggccacgcagcggattcctcgcaggccaagccgaagaagcacgagtgctcgatatgcggcctcgatttcccgattggccaagctcttggtggacacatgaggaggcacagggccgccatgctggagagattggcgacggccaccgcaaagcccgtgccggtgttgaagaaatcgaacagcaagagagtcatgggcttggatttgaactcgtcgccgacagaggacgacttgaccttgcgtttaggaaaggttacgccgcctttggcgctagatcttgttttg

SEQ ID NO: 1674 - protein, 194 aa, Eucalyptus grandis
  Eucgr.B02395.1
SKRRNQKNQTLQFHILYYRIPEMVKRDREDTEVEALAVANSLMLLSRVGQSSDSNCKSWPTERMFACKTCNREFSSFQALGGHRASHKKPKLISGDLFHLGHAADSSQAKPKKHECSICGLDFPIGQALGGHMRRHRAAMLERLATATAKPVPVLKKSNSKRVMGLDLNSSPTEDDLTLRLGKVTPPLALDLVL

SEQ ID NO: 1675 - DNA, 483 bp, Eucalyptus grandis
  Eucgr.B02397.1
atggtgaagagagacagagaagacacggaggtcgaagccctggctgtggccaacagcttgatgctcctctcccgagtcgagcggatcttcgcgtgcaagacgtgcaaccgcgagttctcgtccttccaggcgctcggagggcacagagccagccacaagaagccgaagctgatctctggcgacctcttacacctcggccactcagtggattcctcgctggacaagccgaagatgcacaagtgctcgatatgtggcctcgagttcccgctaggccaagcccttggcggtcacatgaggaggcacagggctgccatactgaagagattggctgcagcggccgcagctgcaaagcctgtgccggtgttgaagaaatcgaacagcaagatagtcacgggcttggatttgaactcgtcgccgatggaggacgacttgaccttgcgtttaggaaagtttgcgccgcctttggcgctagatctcgttttg

SEQ ID NO: 1676 - protein, 161 aa, Eucalyptus grandis
  Eucgr.B02397.1
MVKRDREDTEVEALAVANSLMLLSRVERIFACKTCNREFSSFQALGGHRASHKKPKLISGDLLHLGHSVDSSLDKPKMHKCSICGLEFPLGQALGGHMRRHRAAILKRLAAAAAAAKPVPVLKKSNSKIVTGLDLNSSPMEDDLTLRLGKFAPPLALDLVL

SEQ ID NO: 1677 - DNA, 516 bp, Eucalyptus grandis
  Eucgr.B02398.1
atggtgaagagagacagagaggacgcggaggtcgaagccctggccgtggccaactgcttgatgctcctcccccgagtcggcgagtgcgccgactcgaaccgcgaatcgcggtctacagagcggatgttcgcgtgcaagacgtgcaaccgcgagttctcctcattccaggcgctcggagggcatagaaccagccacaagaagcagaagctgatccccggcggcctcttccacctcggctgcaccgcggattcctcgccagccaagccgaagaggcacgagtgctcgatatgcggcctcgagttcccgatgggccaagcccttggcggtcacatgaggaggcacagggccgccatggcggagggcttggcggcagaggcggcgaagcctgtgccggtgttgaagagatcgaatagcaagagagtcatgtgcttggatttgaactcgtcgctgatggaggacgacttgaccttgcgtttaggaaaggttgcgccgcctttggtgctagatctccttctg

SEQ ID NO: 1678 - protein, 172 aa, Eucalyptus grandis
  Eucgr.B02398.1
MVKRDREDAEVEALAVANCLMLLPRVGECADSNRESRSTERMFACKTCNREFSSFQALGGHRTSHKKQKLIPGGLFHLGCTADSSPAKPKRHECSICGLEFPMGQALGGHMRRHRAAMAEGLAAEAAKPVPVLKRSNSKRVMCLDLNSSLMEDDLTLRLGKVAPPLVLDLLL

SEQ ID NO: 1679 - DNA, 519 bp, Eucalyptus grandis
  Eucgr.B02399.1
atggtgaagagagacagagaggacacggaggtcgaagccctggccctggccaactgcttgatgctcctctcccgagtcggcgagagcaccgactcgccatggctgaaccacaaatcccggcctacggagcggatgttcgcgtgcaagacgtgcaaccgcgagttttcatccttccaggcactcggagggcacagagccagccacaagaagccgaagctgtccggcgatctcttccacctagggcgcaccgcggattcctcaccggccaagccgaagacgcacgagtgcgcgatatgcggcctcgagttcccgctcggccaagcccttggcggtcacatgaggaggcacagggccgccatggcggagagcttggcgacggccgaaaagcctgtgccggtgttaaagaaatcaaacagtaagagagtcatgtgtttggatttgaactcgtcaccgacggaggacgacttgaccttgcgtttaggaaaggccgcgccacctttggtgctagatctcgttttg

SEQ ID NO: 1680 - protein, 173 aa, Eucalyptus grandis
  Eucgr.B02399.1
MVKRDREDTEVEALALANCLMLLSRVGESTDSPWLNHKSRPTERMFACKTCNREFSSFQALGGHRASHKKPKLSGDLFHLGRTADSSPAKPKTHECAICGLEFPLGQALGGHMRRHRAAMAESLATAEKPVPVLKKSNSKRVMCLDLNSSPTEDDLTLRLGKAAPPLVLDLVL

SEQ ID NO: 1681 - DNA, 594 bp, Populus trichocarpa
  POPTR_0001s24250.1
atgaagagagatagagaacaggcagagatagacttggccaaatgcttgatgctactttctaaagttggccaagctgatcacgagatactaactaattatagatcagcagcagcagcagcagcagcagcaacggcaggggccggggccggggccggtcgctcattttcatgcaaaacatgcaacaagaatttcccttcatttcaagcattaggaggccaccgtgcaagtcacaagaaaccaaaactcaaggaatcaactgggaacttgttgaagctgcctaattcgccttcaaagccaaaaactcaccagtgctccatttgcggccttgaatttcctctcgggcaagcacttggaggtcacatgaggagacatcgggcgcctcataatgttgataccaccagtactagtagtaaagatcatgaattggcagctgtgactcagccgcctttcttacccgctgtcccagttttgaagagatccaatagcagcaagagagttctgtgcttggatttgagcttggccctgcctatgtatcagaatgactcggagttgcagttagagaaggtcgatcgtcccatgttgagatgttttatc

SEQ ID NO: 1682 - protein, 198 aa, Populus trichocarpa
  POPTR_0001s24250.1
MKRDREQAEIDLAKCLMLLSKVGQADHEILTNYRSAAAAAAAATAGAGAGAGRSFSCKTCNKNFPSFQALGGHRASHKKPKLKESTGNLLKLPNSPSKPKTHQCSICGLEFPLGQALGGHMRRHRAPHNVDTTSTSSKDHELAAVTQPPFLPAVPVLKRSNSSKRVLCLDLSLALPMYQNDSELQLEKVDRPMLRCFI

SEQ ID NO: 1683 - DNA, 579 bp, Populus trichocarpa
  POPTR_0009s03280.1
atgagctcaattacaatgaagagagggagagaagagggagagttagacatggccaattgcttgatgctactttataaagttggcaaagctgatgatcatgagctgccaactaattataaatcatcgtcaccatccggggccggtcgcttgttttcgtgcaaaacatgtaacaagaatttctcttcatttcaagcgttaggaggccaccgtgcaagtcacaagaaaccaaaacttgtgggatcaactgggaacttgttaatgaagttgcccaattcgcctccaaagccaaagaatcaccagtgctctatttgcgggcttgaatttcctatcgggcaagcgcttggaggtcatatgaggaggcatagggctggtaatattgatgctaccagtaacagtgctgataatgaactggctgtgacttatccacctttcttaccagccatcccagttttgaagaaatcgaatagcagcaagagagtcctgtgcttggatttgagcttggcactgcctatggatcagaatgagtcggagttgcagttaaggaaggccggcacgcgacctgtgttgaaatgttttatc

SEQ ID NO: 1684 - protein, 193 aa, Populus trichocarpa
  POPTR_0009s03280.1
MSSITMKRGREEGELDMANCLMLLYKVGKADDHELPTNYKSSSPSGAGRLFSCKTCNKNFSSFQALGGHRASHKKPKLVGSTGNLLMKLPNSPPKPKNHQCSICGLEFPIGQALGGHMRRHRAGNIDATSNSADNELAVTYPPFLPAIPVLKKSNSSKRVLCLDLSLALPMDQNESELQLRKAGTRPVLKCFI

SEQ ID NO: 1685 - DNA, 462 bp, Solanum lycopersicum
  Solyc11g073060.1.1
atgacaaccatgaaaagaagcagagaagataatggacaagtggaagcagaagccatggctaattgcgccttgatgcttttatcgcgtttaaacaataacaatgactttgcatgcaagacttgtaataaacgatttccatctttccaagcccttggtggacatcgtacaagtcataataaaaaaccaaaattacttggagaaaccaaccaaaagagtaaggtgcataaatgttctatttgtggtatggagtttgcattgggtcaagcattaggcggacacatgagacggcaccgtgatgaaattaataaagttacgtctcatgaaaagactataattccaattttgcacagcagcaagaggattagcatttttggggttaacttaaacataacacccaatgttgatgatttgaagttatggccgatcgaagaggctccatcacctgtcttgcgaatatttttt

SEQ ID NO: 1686 - protein, 154 aa, Solanum lycopersicum
  Solyc11g073060.1.1
MTTMKRSREDNGQVEAEAMANCALMLLSRLNNNNDFACKTCNKRFPSFQALGGHRTSHNKKPKLLGETNQKSKVHKCSICGMEFALGQALGGHMRRHRDEINKVTSHEKTIIPILHSSKRISIFGVNLNITPNVDDLKLWPIEEAPSPVLRIFF

SEQ ID NO: 1687 - DNA, 606 bp, Brachypodium distachyon
  Bradi2g54470.1
atgagcaagaggggcaggggcgtgtgggagatggacaccgcccgcgtgctcatgctcctggcgcagcaccaccaacaccaacagcagcagcagcaacaggcgccgctggcgatgcgcgggcgcgtgttcgagtgcaagacgtgcagccggcagttcccgacattccaggcgctcgggggccaccgcgccagccacaagcgccccaggctcctgcagcagcagcagcagccccagaacgcgctcgtgaacgacgcggcagcgctctgcctggggcggcagatcacgctgccgcggcagccgcagcagatgccggtgccggcaaagcccagggcgcacgagtgccccgtgtgcgggctcgagttcgccgtcgggcaggcgctgggcggccacatgcgcaggcaccgcgccgaggccgacgcgcccaccagcggctgcaaggcggcggcgcctgagacgccgacggcctgctgcgacgccgacggcgggatctgcctggacttgaacctgacgccgtcggagaactgcgccaagtgccggagcgtggcggcggggctcggcgcccggcagggtgtgcctaaagcgctagccatgttggactgctcgctt

SEQ ID NO: 1688 - protein, 202 aa, Brachypodium distachyon
  Bradi2g54470.1
MSKRGRGVWEMDTARVLMLLAQHHQHQQQQQQQAPLAMRGRVFECKTCSRQFPTFQALGGHRASHKRPRLLQQQQQPQNALVNDAAALCLGRQITLPRQPQQMPVPAKPRAHECPVCGLEFAVGQALGGHMRRHRAEADAPTSGCKAAAPETPTACCDADGGICLDLNLTPSENCAKCRSVAAGLGARQGVPKALAMLDCSL

SEQ ID NO: 1689 - DNA, 651 bp, Oryza sativa
  LOC_Os01g62130.1
atgagcaagaggagcaggagcatgtgggacatgcaggagttcgtcggcagcgtggacacggcccgcgtgctgatgctcctcgcgcagcagagccagcacggcctgctgggcggcggcggcttcgccgccggcgcgcagccggtggtggtgcgcggcggcgcgcacgaccgcgtgttcgagtgcaagacgtgcaaccggcagttcccgacgttccaggcgctcgggggccaccgcgccagccacaagcggccgaggcagcagcagcagcacgcgctcggcggcggcgccggcgccgacgacgcggggctatgcctcgggaggcagccgacgccgccgcggccgcagccggcgaagccgagggtgcacgagtgccccgtctgcgggctcgagttccccatcgggcaggcgctcggcgggcacatgcgtcggcaccgcgcggaggccgaggcggcggcgacaacgacgacgacgacgacgaagaacggcgacgtaggcaaggcggcggccgtgaaggcctgcgacggcggcggtgtctgcctggacttgaacctgacgccgtcggagaaccgcgcaaagtgccggaacgtggtgggtctcggcgccggcgggcagggcgtacacaaggcgctcgccatgttggattgtttcctt

SEQ ID NO: 1690 - protein, 217 aa, Oryza sativa
  LOC_Os01g62130.1
MSKRSRSMWDMQEFVGSVDTARVLMLLAQQSQHGLLGGGGFAAGAQPVVVRGGAHDRVFECKTCNRQFPTFQALGGHRASHKRPRQQQQHALGGGAGADDAGLCLGRQPTPPRPQPAKPRVHECPVCGLEFPIGQALGGHMRRHRAEAEAAATTTTTTTKNGDVGKAAAVKACDGGGVCLDLNLTPSENRAKCRNVVGLGAGGQGVHKALAMLDCFL

SEQ ID NO: 1691 - DNA, 573 bp, Oryza sativa
  LOC_Os03g17150.1
atggcttacgggaagaggcctcggcagcaagccgaggaggcggcgttcagcctgttcgacagcagcgacatggcgcgcatcatgctgctcttctccggcgcccacggcggcggcggtggcgcggcggcggcgtcgccgccggagcggatgttcgagtgcaagacatgcaaccggcagttcccgtccttccaggcgctcggcggccaccgggccagccacaagaagccccgcctggcggacggcgacccggccgccgaggcgccggccaagcccaaggtgcacgggtgctccatctgcgggctcgagttcgccgtcggccaggcgctcggagggcacatgcggcgccaccgcgccgtcatggcggacggcctcgggcttggcctcagcctcggcctcggcatcggcgtcgtcgggcagagcgacgacgacggcggcaagaagaaggccgcggccgccgccgccgccgccgagctggtgttcgacctgaacgcgccggcgatagaggaggagccggatcgcgccaggccggcggggctcgccgtagagttccccgtggtggttgacttcccgtgc

SEQ ID NO: 1692 - protein, 191 aa, Oryza sativa
  LOC_Os03g17150.1
MAYGKRPRQQAEEAAFSLFDSSDMARIMLLFSGAHGGGGGAAAASPPERMFECKTCNRQFPSFQALGGHRASHKKPRLADGDPAAEAPAKPKVHGCSICGLEFAVGQALGGHMRRHRAVMADGLGLGLSLGLGIGVVGQSDDDGGKKKAAAAAAAAELVFDLNAPAIEEEPDRARPAGLAVEFPVVVDFPC

SEQ ID NO: 1693 - DNA, 1009 bp, Solanum lycopersicum
  RBCS3 (Ribulose 1,5-bisphosphate carboxylase, small subunit 3) leaf-specific promoter
aaatggagtaatatggataatcaacgcaactatatagagaaaaaataatagcgctaccatatacgaaaaatagtaaaaaattataataatgattcagaataaattattaataactaaaaagcgtaaagaaataaattagagaataagtgatacaaaattggatgttaatggatacttcttataattgcttaaaaggaatacaagatgggaaataatgtgttattattattgatgtataaagaatttgtacaatttttgtatcaataaagttccaaaaataatctttaaaaaataaaagtacccttttatgaactttttatcaaataaatgaaatccaatattagcaaaacattgatattattactaaatatttgttaaattaaaaaatatgtcattttattttttaacagatattttttaaagtaaatgttataaattacgaaaaagggattaatgagtatcaaaacagcctaaatgggaggagacaataacagaaatttgctgtagtaaggtggcttaagtcatcatttaatttgatattataaaaattctaattagtttatagtctttcttttcctcttttgtttgtcttgtatgctaaaaaaggtatattatatctataaattatgtagcataatgaccacatctggcatcatctttacacaattcacctaaatatctcaagcgaagttttgccaaaactgaagaaaagatttgaacaacctatcaagtaacaaaaatcccaaacaatatagtcatctatattaaatcttttcaattgaagaaattgtcaaagacacatacctctatgagttttttcatcaatttttttttcttttttaaactgtatttttaaaaaaatattgaataaaacatgtcctattcattagtttgggaactttaagataaggagtgtgtaatttcagaggctattaattttgaaatgtcaagagccacataatccaatggttatggttgctcttagatgaggttattgctttaggtgaaa

SEQ ID NO: 1694 - DNA, 1714 bp, Arabidopsis thaliana
  RBCS4 leaf-specific promoter sequence
caaatttattatgtgttttttttccgtggtcgagattgtgtattattctttagttattacaagacttttagctaaaatttgaaagaatttactttaagaaaatcttaacatctgagataatttcagcaatagattatatttttcattactctagcagtatttttgcagatcaatcgcaacatatatggttgttagaaaaaatgcactatatatatatatattattttttcaattaaaagtgcatgatatataatatatatatatatatatatgtgtgtgtgtatatggtcaaagaaattcttatacaaatatacacgaacacatatatttgacaaaatcaaagtattacactaaacaatgagttggtgcatggccaaaacaaatatgtagattaaaaattccagcctccaaaaaaaaatccaagtgttgtaaagcattatatatatatagtagatcccaaatttttgtacaattccacactgatcgaatttttaaagttgaatatctgacgtaggatttttttaatgtcttacctgaccatttactaataacattcatacgttttcatttgaaatatcctctataattatattgaatttggcacataataagaaacctaattggtgatttattttactagtaaatttctggtgatgggctttctactagaaagctctcggaaaatcttggaccaaatccatattccatgacttcgattgttaaccctattagttttcacaaacatactatcaatatcattgcaacggaaaaggtacaagtaaaacattcaatccgatagggaagtgatgtaggaggttgggaagacaggcccagaaagagatttatctgacttgttttgtgtatagttttcaatgttcataaaggaagatggagacttgagaagttttttttggactttgtttagctttgttgggcgtttttttttttgatcaataactttgttgggcttatgatttgtaatattttcgtggactctttagtttatttagacgtgctaactttgttgggcttatgacttgttgtaacatattgtaacagatgacttgatgtgcgactaatctttacacattaaacatagttctgttttttgaaagttcttattttcatttttatttgaatgttatatatttttctatatttataattctagtaaaaggcaaattttgcttttaaatgaaaaaaatatatattccacagtttcacctaatcttatgcatttagcagtacaaattcaaaaatttcccatttttattcatgaatcataccattatatattaactaaatccaaggtaaaaaaaaggtatgaaagctctatagtaagtaaaatataaattccccataaggaaagggccaagtccaccaggcaagtaaaatgagcaagcaccactccaccatcacacaatttcactcatagataacgataagattcatggaattatcttccacgtggcattattccagcggttcaagccgataagggtctcaacacctctccttaggcctttgtggccgttaccaagtaaaattaacctcacacatatccacactcaaaatccaacggtgtagatcctagtccacttgaatctcatgtatcctagaccctccgatcactccaaagcttgttctcattgttgttatcattatatatagatgaccaaagcactagaccaaacctcagtcacacaaagagtaa

SEQ ID NO: 1695 - DNA, 1923 bp, Arabidopsis thaliana
  At4g01060 (G682) promoter sequence
ttattaagtgctatgcgttaatcggcatctataaagtgttgcattgatgaacaaagtggatgcctaaactagacgtttaactaaatgtttagaatgaaatcttcatctcatctaaaaagtgttgcattgatgtaaaaagtggatgcccattagttcttggctttgaaatgtttttagaatgaaatcttcatcaatctccatatgtggttcaatccactcattttatcttttgttaaagatgttcttcaggccaatataatgatgaccatggatggtttgcaactcgcatataacacttctttatccgatggttacaagtattacatggctatagatagcttttgcatgcaacaaattatctatcaaagtttatgcatcctctaaaatatggtcattggcaagccactaaacgtatatattgtgacaatgtatgatgatatatttttatgtgttgactccgtttttcattaagtaatgaaacatgttgctctagattaccattttaatcgcaaacatatatgttgctctaccacgcattgcatcaaatgataagcttgaggacgcttcgacaaaaacatatttctccttcttcttactgaaccaaatgacaattgacaaaccccattaataaaatcggttagtgttaatgtgtcactcataatattaacttagtaaagaacaagaccacattaattaaatcaggtgttagtctgagaatatacgtttctcttcctcattccaaacttaaattcggaatttactgagaatatattgttagcactgaaaaaggttaagttgaaagtttgctagggatggcaattaaatatagtcttgccttggggatattcccttcgtggacttgtaagtttatttataggtcctcttatgtatatatagatgatctaacgatcgatatactatgaaaaaagttgttactagattttattgcaggtaatagtgttgaataacccgaaccaataaagcagttgtaacgaacacacgacacgttgcttactgcgaggaccactttgttttttgttttttttggctttaagccaatttaggaccaaatttgcatgattgaggatgcaagtatccaacccattttcatctttcgtagtgacactcatttacttttgtgatggacacgttatagtatatcttaaatattaaagagacatgattgggggatcattgttttaatttaaataatgtagattctattcttttcatggtattaatccaatttatagaaagttatgtgttattagcaattaagctaaatgatgaaaacaatcagtttagtgaaacaaactcgccgagaaaacatgaatggttgaaaatattattgtgttttacaaacgtacacgaggacaatagttttgtaagtttttcttaggcattgaaaaatgtttgatacaaaaagtaatgttaaaataattaaaaatgattttgtcttaatatatccaaaatttcaatctattatgaacaaagggagtataatttctgattgaatgaactggaatagcaatcagaaaagctttgaaaacaattgttgttgattattaatgatcttaattaacggcatgtatcaatatttatacaacttatgttccagtccaagccatcacaacggagtaaatgaagtcacgggtacttgtggtttttattggttgcaaacttgcaacttgcaaagatagctaacaataattaatataattaatgagaacaaaaccaatttagtaaattaaaatcctttaacatagaaaccgaccaaacccgttggaccgttggttacttgatttggttagttgctataaatagaaatgatggttcgtgtgcaaccttcaaaatacgaccactctctcagagtactctcttagtttctttcttcttcttctttgtaatacggtgccgtttgac

SEQ ID NO: 1696 - DNA, 1500 bp, Oryza sativa
  Os02g09720 location: Chr2:4997678-4999177
ggccgtcgtcggcgagttctcagctatagcttggtagctatctagctcaatttgctgtctccaagtgtgacagctagttgtaattgagttggtatagctttggcctcttcttttatttttttcaggccgtttagatggtaacctctctgacttgagagagttagagaggccttgtatatacggagtatatagtactccagtttagttgccatgccagcagttgcatgcactagtaagcaactagtctctcggtttcatattacaactcgttttaactaagtttatagaaaaaacatagtcgtatttttaatacaaaacaaatatattatcaaaatatatttaatgtttggtttaattaattaacattggtgtttttgatgttactaattttttttataaacttagttgaacttaaaataaattggttaagaaaaagttaaagcgacttgtaatatagaacggaggaggtagctattggtcaaggggatgtgcatccatgtttggtaggtagccgtggtggctttggtgtgtcattctctatcttttccacacacacactttaaatttgctggctttttagaagaacaatggtaatgtttcgcttttattttgctcatggtaaaaagattgtgtttcgcttttcgaggggcaaaaattaagtctaattgatgctattgattaataagatcgtgatcgcgaggaggattgagatgtctcgatggacataatagaatcttaggttcaaggaatttacactctttaataaagacttcgcttgcaaagatgtaggccaaatgaaagagacttaagcatgcttgttgatataatactagtttattttgagaattaggatttaatttgatgcactaaacctagagtaaaaaccataagatgacctaaatctgtgccaatatatttctagttggttcataattaatcaacggaatgagtatgcagtttttctcttaaaatgcctataggagttaggtgccatgctacaccacactactgaaactgaattggtgccggttggaaaccggctatagatgtcggatatcctaactgatacccagtagacgacacctttggcttcagtcatcgatcccgccggcatcttttacttacaaaggtgtcggttttgaatacagaaccaacacctatactgtcatataggtgtcagttcttaaattgattggcgtatggacagttttacatgtgacttttacaggtgacagttcgtaaatacaactggcacctataagaagcatatatgtgccatttgtacaccgggcaggacacgggacaagggttataggtgtttgtttgtaagtaaaaccagcacctatatgttagcaagaaaaaaaataaaaatgataggacctaccaatttcacatacatatcacacaataacagaaattcacatcacttcaaacatacaaccacattcacattcaaccaaactatatatattcaattccacatccacaaccctcatccca

SEQ ID NO: 1697 - DNA, 1500 bp, Oryza sativa
  Os05g34510 location: Chr5:20455817-20457316 (reverse complement)
ctatatcttcctacctatccccctgcaagctaacaaggggaattacttgcacatctaatgatggactggtgttgttatgcggttgtgttggggtgagatggaggatgtctctcctcccccttgctagcctttaaaaaggagtcctacaggggcataacaggaatgagaggaagcttctggagatcaattctcacaacacacatttcctacagtacagttttgcccccagacagatcggatggtgtgtgtcagcagcctctatgcctgtaggcatgcattcagttgaatggttttgtctcgatcgacggcgaaaaaggatttacttttggacaagaaaaaagagcctttaatccatgagattactacatctcgcatacagggacaagtattacagctgtgagtgatgcttaagagactttacggttttgtttgcagctaagcaggaattaatataaataatctcccttttcagggctctgcttgcatgaatagctaccagccagagccaagagtgccagagacatcaagcctggatggtagtagtacagtacttgcgttactcgtgcccggcgttgctgcttcggtggggcccacttgaactggccgtcctcccgagccgtcggtgggggtggtccccaccaccggccagttactttgctcccgtcgattcggcccggtgcaccaacagcccatttttttatgatgggcttgcaacttggcccaacttgttggattgtcaaggccggagggaggcccatctgggcgaacttgtgtgggccgcttctttccattttagagaggaaacatgggctgggctacgggctgcgggctgccacctatcaccggagaaacacttgctcgcagcctcaaatacttgaaaccaggctttgaaaattcggcaaaaatcatcaaacctccgaaagtatgagagaggaaaatcaattatgatcttcctaattgtgtcatgattagcatagcgcatcaaagcaccttatcggtgcaaaattaatccctttcaaaaccattgtacttcatgaatcttgctacatatcttaaaaacgttgacgggcttacagcttaccagagatcaaagcgagaggcagaacaaagttcaaaatctgccgtgtataacaacaacaagtaattacagtagaaacaccttactactcatcaatcactactactaacaccaccacatacgaatcatttctaccagatccaaacaaagaaaaaaaaagagggagagagaactaattaaaaacacgaaatccgaaccggttcaactaatcaatcttcgccacaatctccagctccagcgatgaactgatgatcatggcggccaccaggtcaggtgtatgtattcacaggtttcgccgcgatttgacatgattggaagtggaacgcaaactcacgcggccactccggcgccggcgccgatgcaggagaagacgcggacgctgcgggccttggggagcgctacccgcggcagccgccggccag

SEQ ID NO: 1698 - DNA, 1500 bp, Oryza sativa
  Os11g08230 location: Chr11:4325545-4327044
cgccgtatccaccttcaccagctcgatctccgtcgttgatcgttgattgattacgtactacctgagtgatgatggacgtggatcactggaatgggttgagaaaataaaaatgatttatgtagtgtgtaggagtactcaactaacaattgaacgaccagaatttgacgaattttatttacatgtttagagaccctgggtagagattcagtaataattaagttcttgccatatttttgcatcaatttaattattttactaaaatgatttatgttgttttattttcttggcactatatttgcatcaaatataattaaacttagcttaactggccagagcttatatatggctcagatttaattcccctcttatcttcagagcattaaaaagggagtatcctaaaatacctatctcctaaaagatcaatctgcctgtggctcaaatctatataaagtgagctcccctcccactgtcccacatatctatatagctaccatggcactacagcttgcaacacgctcaaggaagtctctcgccatcgccgtcgccgccgccgtgccgctgctgatgtgcctcttcctcgtcgccgccgccgccgcggctgcatcgtcggagacggcggtggcgagctccccacagtaccagccgagctatggtaatacgtactcgacgtgcttcgaggtttcggcatgcgatgacaccgggtgcgcgatcaggtgccgcgacatgggtcacaaccctgctggctcagcctgctggaccagcaacgtcgcgaccatcttctgctgctgcggccgtggtcgtcctcctccggttgcttgatccatatgtatacataattacatatatggtatatgtataactggataataaagcgtatgtgcgtgtcagcgtgagttggtgaagatgacttataacatgaaacaggagtagcgctagtaatgagatgtgtgtaaaaatgttatggttcaattaattaatcaaagtcgatctttgcattgcatgctgatacatatctatcgaaatatatatgtactaagaccaagaatcaaagtcgtactactcgtatatgtacaaaataattaattttaggcaaattttgctacaggacaccgtaattgtgtggttttagcctagggacaccgcaaaaacaaagtttgaggaaagacactacgtaaccgtggatatttgcgatggacaccgcaccgtctaaacgaaacttgctatgctgacgtggcggtcgggagccccttttttgacgcggtcggaccgaaatgcccctgcaccttacctcctcatattgcttgctggacactaaattgtttgctggacactaaatacatagatagatacatcgtacatatacatgacagatataccgacatggactacgttccttctagccaccgctgccggcgagctccaccgccgtcatatggttgttgcgcctggcgtgagaggtatatgcggcattgcatcactgtccggccaactttgaattaa

SEQ ID NO: 1699 - DNA, 1500 bp, Oryza sativa
  Os01g64390 location: Chr1:37374848-37376347 (reverse complement)
tgtccagggctccaggccgtgatcagcgctcgctgctacgctcagaccaacacaggaaattattacttgctccctactactacgtgcaagcagcgtaaagggggcaggccactgtttgaaattcatccctctcaccttttgaaacagccgcgcgtcgtgccgctgtagtagtgcagctgtgcaggtgcagtagctttgggtcaaaactcaaaactcgaaagggagacagcaccaaaaagatactgcggctgcagccacacagggctagctgcttgacgcagagagttcgtagcgacgttgctcgtctgggcatggcagtcgcgcctagatcggctcgtgcacggcatgcgttgcttgcctgggtacgccaccacctgcgcagccagcgatcatggccggcgcggcgtcccacggcacgagagcgagcgcgcgcgcgcgcggcactctcgtgaaggcgtacgcgccatccggccgcgcggcgcggcgcaggccggtgcagcgtgcaggttgacccgcgacaggcgcacggccgcacacgcggtgcggcgggccggcggcctggatttgggcggagttctcggtggccgtcgcttttcccgtgccagctgacgcgattacgagccgtacccgatcaaaaccggcgtgatcgccggtccgatgcatgcgttttgttttcatgccagatctttggtaatcgttagtacgactctctgagtccgcgagtacgctggtttctgttaattgcagcctacagtattttctttttcttttttgcctcggggaagcgatgcgagcgatacgtgataatttcaggtggcgcagtgccgctgtgcatgtgtgaaatcatgcaagattggcaggttgctagcgcgcacgtactcctctctggtgtgatcggtttcaggtgatagagacgatacatgggcataccttgacacggagtgggctgggatggcgcgggtggtccatcggctacagccttacatgctcctcctatcaaactctcgttatgtccagttcacttggcccatccttggtttcctctacgactagtgctcctctagccagtagccactacccactgtttccatattggcgcacgggtcatataagatggtttgttcctgttcacctgacgggaaattctttctcctaaaacgatatcgaaccatccttatccggattggattaacgagatcgtcgtgctaagtgtgctaacacacttgttatatgaccgttattccgagttcgtcttgctgctgggagagttgcagaattgtagtactcccttcgtttcatgtgacaagacgttttgactttagtcaaaattaaattgctttaaatttgattaagttcgtaaaaaaaagtactacctccgttttacaatgtaagtcattttagcattaacgagcatggtggctcgcgcaaattgcgcggctagcatcattatattttctctcatataatagcatatatgttttctcattatattattcaaat

SEQ ID NO: 1700 - DNA, 1500 bp, Oryza sativa
  Os06g15760 location: Chr6:8954266-8955765 (reverse complement)
ctccggcgaggcggtggactcggactccgactccgacgaagtcgaagagatgatcgaaaggtttgggagtcgcggcggcgaggatgaggggggtggatttggtatatttacgggcgcgggtttgggctttttttcgcgaatgggccccgcccggtttgacttctgcgatagggatgcccctcaaaaggtagaaaaatactcaaagaaatactcctaactccgtttctaaatataagtgatatatatatactactcaatcccttttagattggaagatgttttaactttgaccaaagtcaaactactctaaatttaactaactttgtagaaaaaattagtaatatttataacactagcatagtttcattaaatctataattgaataaattttcataatatatttgtcttgggttaaaaatattactattttttttacaaaattagtcaaacttagattagtttaaatttgaccaaaatcaaaacgtcttgtaacctgaaacggagggagtatttcttttagctggagaataggtgaaactatccctcttcaaaattttaaccagtcggatttttataaaaaaaaatattttcaaatattttagacaagcatattaccaaattatattgcatcttaaatatataaaagtattgcgaagtggtgctatactttttggcgcaaaaaaaaactcaaatacttcacatccctttttatataagggaaactttcttttactgaaataaataataagtgaaactatttatctttagattttagccactcgtattttttagactgatgccacttatttttctaaacaaggttttcaaatattcaaaacaatattattctcaaattataaaagcttgaacctttgtttatcgtaatacaaccatgtaagaaatttttagtggtgaaaacgaaaaattgtccagccaaatacatgtcatcttcacatcttctactagtttgatccacctttggtgtttaatgttttcacaaaaggagtaagatactacgtcgcacaattttggaatcagttgttggaaataatttattctattttggatggcataatactttcagactttcattatagaatttactatatgatcattttttttatatttcagctggctatcatttgaagggatgggtgaatttatcccatgacattaatcccccccctccccctaaatttttataacttatcggctgtgtcttttatataccacagatatgaatcagttttcatcattattaaaaaaaatcaagacaattattttaaaacaatatttagcgcggagattcgtgctgggtcgtccacgtatgcagcatgggtgtcgctgtggggggtttggtgattgctggtcgttgtcgtttcgtggccggttgcagtttgtagccaagggtggtggcatctgatatctggccacacactttggttatggaatgctgggtttgctgctggtgtggtgatcaaccggtgggtgattggtttg

SEQ ID NO: 1701 - DNA, 1500 bp, Oryza sativa
  Os12g37560 location: Chr12:23047433-23048932 (reverse complement)
tgacggcgtctccttcttcttgcttcttgcttcttcttcttcctcctcccgatctggggttgtaggaagctactggtcgtgatcaatggagcattccgccatggatggattggatgggatggggagaaggggagggggagaagcgcgcgttgctggcgatgttctctccgcgtggggggtgggatgcgatgcgatgcgatgcggaggaggaggaagacgacgaggactcggctagtctggagttaattgattaattaattgattaattaggagcaggagaagtgcaagcacgacgagagtgaagggaaaggaaccgccgtttcaaaaaagatggaatttttgcggccaaccccttctactagtgacgaatcacggtcatgtttgccacaactttcaggctgagttcgtttctttgatactccattcgtaccgtaaaaaaccagcctaatactagatgtgacacatcatagtattacgaatctggagatacctctgtccagatttattgtactcgaatatgtcacattcagtcatatattcgttttttttggacgggggagtatctaattcactcctcggctaatgattaattaatcatgtactaatggatcactctgttttccatgaacacagcctcgggttaggtcttagatccacgacagatttaaatttttaagttttatttaaaatatgtgtaaaatgatttatccaaatgttatagacataattgaggatctaaatacatggatttgtggagcttgaaatattcagcttctaaaaatcttgaatttggagctatgctaaagaggacctacgtatcctgcagttaacttattccaaaaagaaaaacaatatccaaacctgatgcttaaaaaaacacactgaaaattaaaggcgttatataaaaagtatatataaagtattaaacttgacaaaatgtgttggagaaaccatgcgtaaaactccagatattacctggagacaaaagggcatgtagtcaatgattgcaaaacaaattctctggaagtaacggaaataattgaaagttatacatatccaagtaggatttactacttacatagccagccattatccactgataattgctgctattatcaccataatcaaccgaataatcagccaagaggttatcccaacgataaatgactttgatctctcctttggtttaactcaaatgaatgataatggcttatcaaatgaccagtcatcttgactacaaaatcatatgataattaacctcattaatttatcactagtggctgataaaatgggatatagagaatgctttggaattcatgatatttgctaatttataggtaaatttctaacaaacatatggtaaaataaacccccataataatcgtactaccaaactataccaaacaagtactcttagcatgtatatatagccacaccgatcaactagaagactcaaaataccaataggttgtcggcatcgcctaaccgtgatcagacatc

SEQ ID NO: 1702 - DNA, 1500 bp, Oryza sativa
  Os03g17420 location: Chr3:9689781-9691280 (reverse complement)
gtgttcgcacgacgatagggctctgacttcttatggaagatgaacatgataaacgtagatgccttttcatatagtacgacctacctgaagacatgagatgagatttattagacgttttgctggtcaacacacaacacgtcgatgactcgtgcgacgcaaatgcaaatccagatgagttagtggaccctcacacttatacataggagtaggtgtcatctgagtcaatatactagcaagagtgagtttgaaagagatgttgggattgagcttttttttagcacatataaaacgagataagtcattactatatgattaattaaatattagctattgcaatttgacttctatgtaaaaattttttttcaaaaacatatacattagtttgcaaagcgatgaaatagtttacccaacttctctttagaactcagcctaaataaatctaacccctaaatatgctaaatgtgccagccctagtccaaaatttaatgagacctaccataagaatgttgacatgacatcttcaccaatcctacaaacccttaaaaagttaaaagtttgaagaaagttggaagtttagaaaaaaagttagaagtttatgtgtgtagaaaagtttttgatgtgatatgatgtgatggaaagttgggaatatgggggaaactaaatacggcctaacaagtatggcacacacacgctttatttttaccttttttcttctttttattctgtctttcattctccttttctatttctttgcttctatgttcttcctcaagcgagccttccttgagctcaagttgttgccattgagctcatggtgggctggtgggcatagtcgtgcactcacactaagcaactatcgttaagctttccatggctgctgtaacatcccggcccagggcttaataggattaatataagacttgtgcacacgagtgaggacaaagtgtgcagaaaagacttgtgttggtctgtgagggcagtctatgacctatgaaagctgccagatgtaagcggaccacttcttttctggaagccgatgtccaaagaactttagggttaagcgtgcttggcctggagcaatttgggatgggtgaccgaccggaaaattcttcccaggtgcacacgagtgaggacaaagtgtgcatgaaagctgccagatgtaagcgggcccagcttgggagaggcgggacgttacagctgcgatgcttaagcgtccctatcggccgccaccatcgagctcgtcctacccttggtcaccaccactcctctaccatcactgagctcctatgcatccacggccaaaacaaaaaccctatccttacgtatctcctctttcaccaaccgaaacccaccctagcctccattgcttcagtcaccgccattaaacaatattagatcgaaatcctaattcttcgccagcacaaaatgactaaattcattagtgttgcttctcatgttccaaaattaaacatgtatacgagttcattgtacccggtaatc

SEQ ID NO: 1703 - DNA, 1500 bp, Oryza sativa
  Os04g51000 location: Chr4:30185779-30187278
gcgaggatggctactagcttgctgtccttgcggtcggccgggctcggtttctccggttgtttcttgtgtttcgcccacacacctctgtgcgtcgcgttgggctcgttatatagcggccactgtagtgttgggctatagttgctgcacgcggttgacttgacaaatctccatagctcgttgcattggtccggatcgatgtatctgcattcacgctagcttttggtttttgtccaatacttggaggaagggagcgagctaccgatcgatactacgtgaaaacgacctgtcctgtagaaagctgcatgcgtcgctagagcacacacgatttgatagtctagattctagtaagccctattacgtgccggtacataaaaagtaggcacagtaagccttataggagtaatacacccacacattgtgttgtcctgtcacggcgtacgtgcatttgtaatgtggcgcacgtctcaagtgtccttcgatcttttcgtcccgtctctccttggaggtagcaacggcgtcactgttcctcttccgaagaaaaaagatactcctgcatgcgtactgttgttgcgtacacggtgaacacgggtgaggccgtagccttgtgcccttaattatcgtacgtggcggttgtccatgtaatcgtgtgagcggtgggggcagaagattagcgtgtcattctgcagattttccccacgctagggcaactcaaaaatgtttttgattccgagggcgaaaatatactttttaagaattattttaccattctggataattaatgtatcgagagacaccgtatttttttaatataaaacttaatacttttagatactgtgtattttgagataaacaaaagagtaaattgcatcagcggtacacgaacttgtcaggttggtgcaatctagtacatgaacttctaaaacgctcgtttctgtgcacgagcttgtttgatgcgtgcgaataatgtcaaaatcgcactgcaaggttaatcttgttgattctgtggttgatttaaactctatgtaaacattagtctaagaaggataaacatataataaggcataatgattgtataaaaaaataaaaatttgagtaatgatgcaagggacagaaacaaagaaagataaagtggaatctaagaaaaatcggtcttgtcgcaccattttagtcttagtttgcacataccagacaaattcatgcaccaaaacgagacgagcattttataagttcatacactaaattgcacgcacctgacaaatttatgtaccgctaatataatttactctaaaaaatgtagtgtaaaatttctcttcttttaaagtctcactatggtgcattcattggtcttatttgattggaggatttagatcttttttacaattatttcaattaacggtagtagaaatatggagtgatatttattgtaaaaaagaataatgtgcatggtgtataattgtcatttagcaatgattaaatatttgtttctctttctggattttt

SEQ ID NO: 1704 - DNA, 1500 bp, Oryza sativa
  Os01g01960 location: Chr1:522445-523944
gacctcgaggaactcctcgtatttctccctcttgtcctggaacttatccttgacggccttgaggtagacgagcgcatcgttcgtggtgagcttctggccggccgttgcgccgccggcgggcggctgagcaggcggagcagcggcggcctgaggcggcggcgctgcagcggaggcaggccccagaggcatgtgctgcggctgcgccgtcctacaccacgagaggaggggcaaacagttagatcaaaacgcaaaacaaaatcgcaccctaaaaaacacctcctttttttttgcgacgtagagttagaaattggaacacaaaatttgacggtgaagaagagagattccccaaaggaaacccgaattcctcccgcagatggaaataatatatataattaattattcactccctcgcgggctgagggtgagggaaacgaaaccgaagtgaagtttattttgaaaaataaaacaaacgaaataggcaggaacgcctggaagggcgaaggcgatgagcaccgaggaagccaaggatggaggaggcgaggagaaaagcactcacggatcggatcgaccgacgttggggcgcttgagttgggagcccatgagcgcgtcgtccctggcgcgcttcatccccccatacacagactcccttcctcctcctccccctcctcccttcacccaaccaaaccaccgccgcctcctacagaacaacctcccggtcgccgccgccgccgccgccgccgatcctctcaaacctcggaagacgtacaccggcgccggatctgcccgccgctggctcctgcgagaccccccgagcgcggcgcgaagagggcgcagcgcgaggcgaaggcgacgcgcggggaggagaggcggctaatcgcctcggcgagacgcgagacgcgagagggaaggatgggtgaggaacgaggcaagggcgaggcgaagaagaagaagagaagcgaggcctcctcttctctttaacacaacgaagagaagagagcgcatcacaacccatgtacacccaccggtgccaccacgctgccccgcgcccgtcgcgaaccacatcccgcccgcacatccccagataagggacacgtggacgtaccggatcgaccgccctagggtgcgaaatggttactggcggtgatcgcaccggtgggagggttagcttgtttcgtgggtaaacacaacctacccattggatttggggattccagtgagcggtctggattagcgcggggttacttcgagattagtgcccccgggcccacctgtcagtcggatgagtgcctccgatctcaggtttaacctagctccgctagggcggcgtcggttcgtatatccgcctcatgcgtgtgtgtcttctggctcaggagacgtatttccgtgggatccgtatatacatgggcttcatttggccatttgtcacgatccctagcttccagagagggctaccgctggatcttcagtttcatctgcagtatcaaactattaataaaaaag

SEQ ID NO: 1705 - DNA, 1500 bp, Oryza sativa
  Os05g04990 location: Chr5:2418356-2419855
tgataacgatggtgcgccttcgtgatcgatcgagagcgtgaggagcaacgcggttcaatttatagacgatgcagatcaagctggtgccaagaagtggcgggaggttgatgacgatcgatcgatccgaggaagaagaagaagaagaaatgtaagtggtgatggtggtgatcgatcgagttgagttgagaggcggcatgcgcgcatgcatgaggatgagggggaggcaatggtaatgattgtgagcattatggggaggggagaggaggatcttggtgattaatgaacaacgttaatggtggaagtggtggcagtggggatttcgaatgagatttttctttttaacgattagcactagacaacacgactatgagaaatacccaagggtcatctggctagctctacaaggtggtaggccagatgatctgggttcaaagcctcgccccttttaattatttgatattagtctttttctaatattcatgtcttttactagacagtacgattattcatcgaatagaatatgaaaaaattacaagattaattagagacctagaagacaatagctaggaaagaagaaaaaaaatccaccaccacgcaccgacgtcatctacacacagccaaggagaaggtttagcaccggaccagtcggcgctaagcgtgaccgactgccgctaaaccaacaagggtatgggaatgaccgctaagattgcccaagtccaagctataacagccgagcatcaaacacaactctagccacatctataaaattgaggggaagaggatgagagagaagaattgaaccgctctctacgctaggccctctaacgtggccaatttgtttaaactagggcgccaccacaagaggatgagacatctaaagtgagcttgcaccagttatctatgataagatttgtcaagggggctttctagatgacgtctccagggacaggagcgacaatgacactgccgccaccatccgtcgaggtcttaaggagaactaagacaagattttcactcgataaccctacaagaggagaggggatggctcgacaacaccccgaagaagtaagatggcgcctgaagcgccagccaagaccgggctgggtttacacccgccgtcccgccacctgccgatcgaaagctgtgctccattgctacaaccaccatccatcctccgtcgcgcgtgggcaccgttgcaccgccggcccccgccggccaacctccatgcggcctcccactctttgcaccggacagttgtcaggccatcaccgtcgccgaccgccggcctttgccgctccgtcacccacgcctgccacaagccgtcggcctacgtcgcccgtgcccgtcgcaagccgctggcctctgtcgctgtctcctccggtctctagattcggcagcggctgtgccggatctaggcgcgggggagcgggggtggatgtggaggtgggggaggaaggggggcagatctggcagcggtggtgccggggacactatctcgag

SEQ ID NO: 1706 - DNA, 1500 bp, Oryza sativa
  Os02g44970 location: Chr2:27240720-27242219
ggttgaattccacagggaaagctcatcatttacaattttctggaaaacaagtcttgactcagacagggcccctaaattagcataacaactcacaatcttagagccaagaatcacatcccagcacaatccatgtgtgaaaacatgacaatggatcttctttagagacctaatatctgcacagccttggaacaatggagcaaacttgtcaaaattaagtatcttattagagcatgaatttgcatcggcagtggatgctgatagtctccaacgcagcttcagcactgcaattttatcaaactttgaactagtgtttccagctaaattcccctcaaaagaattggtagcatcatcatggttgttgacgcaagaaaaacaaaaataggtaactaattgactccgaattcatagacatacgatgacagttcagttaaatgagcctacaatataatagtcccaagcacacatgtgtgagtcatgtgcaatgattacatcatgtgtgcttgggactattatattgtagactcatttaactgaactgtccaattgtggttggtgacatggttcaggagtctaacggtgtaccggaaacagatatagtgtatatctggaagtggagtctataaataggtccctaccctccagcctcataatgcattgtgagcggaacaacggaaaaggaatagagggtaggccggatagacccacgtaaacctaacaatatttgcttttcttgcacctccaaggatagactattcaactaaacctgatcaacagcggaacacatacaatcagtgtactttagtacaacagcactaaacttgatagcagatcacattaaattaagcgataatcccagttatggcatacacagcagaggagtgaagccacaatctctccaggacattgccacaggtaatgaatatgaaatactaccgcaatctcgccggtgctaccaaataaaccaccacctaatcagaacaaatagccacatcatcaagcagtcatcatgtaaaaacgagaaaatgggaaaactgaccaccagccgaaatctttttcagaggttcattccgtgaaagaaccggagtaggaggaggaggcctcggggtggccgccggcaagccgacctccggagggacggcgccaggaacagtggaggaggggcgcgcgcgtgggggaggcgcgggtggtgcggccgtgcgagggggcggcgctgccgctggctagtggagacatcggagttcggagcgaggagaggtggcgtggcgagacggtggggaatcgcgtgggcctttgcgcgtcccggagaaacggccgggtcgaaagcccacactaccattcggcttgggactagctatccatcacgcgacagatttttttttttccgaatcacacagattttatttttttttcaaatcacacagattttagattaattgaattaagctcatttgatcacttgattagaagagttatcaacatatattgcatatattttattta

SEQ ID NO: 1707 - DNA, 1500 bp, Oryza sativa
  Os01g25530 location: Chr1:14470301-14471800 (reverse complement)
ggttgtagatgccagaaaaatgaatatgagtaactaattggcttcaaattcacaaacatgttttgcttttattgcacctccaaggatagactattcacctgaacccgatcaacagtaggggacatataatcagtgagctgtagtacagcaacacaaaaaatgatagagaatcacattaaaattaagccagaattccagttatgatgtacacaacaaacaagtgaagtccaggggcggatccaacttgggacatgggggttcagttgaacccccaaacttttgggtgaacaaacaaactgttattacctgaattatttaagagaggtttaaggctatcaaattaaggaggaggagaagatctagaagagaagctagtagggttcacgaacgcaagcaaattccagtcccggtggggtgggagagagagagagatgaatcagaaagaggacgcaccaggatcccctcccctccgctgcgatggagatcgccgcccggccctcccctgttcagccgcgactcgtcttggcggcggcgcaacgaggcaaggagcggaggagacaacgagaggtactcgactactctgcccttatctcaatatttttacttaccactctctacgtcctaatagttttacaaggttcacatccaacatttaactttttatcttatttaaaaatttgaaaattttttaaaaacggacggtcaaaagttcgacacggattttcacggctacacttattagggacaaggtagtattttaaaactagctagtgttatttctttatataactggtgacccatgtatcatcaatacttaggaaaaaattaaacgattgtgtcgacaacaaattcctcataccaccagcaaccgctaactgccactctacgcaccgccatcactgctctttctccatgaatcaccatcgttcttctcctttgcctttacatgcgcagccttaacctctagtaaccgacaagtctttttctcctcccctatcgtgatgcgcactattgttatcgttgccattgaggtcggagatgtcgggcttgcagggactttggaaggcaggagctgacccgacgaagaacgaaggcgctatatccgggctctttcttgctagatctatcggttatccaactgtcgtatggataaagaaaatggagagagagaaagagagagagttaatgtgcgaagtgattactgagtcaccggacttggagatggatagaatatggtggtctaaattaaaatgtaaagttagctattgtgtaaatgaaaatggttaaatgataccattatatgaaaacttttaagaatttttaagaatacatagtatggattgtaatttacttcctttgtcaaaaaaacgaatgtagaactggtgtggcacattctagtacaacaaatctgaacatatgtatgtctagattcgttttactaggatgtgtcacatccaatcctaggttagttttttatgggacgaagggagtacttttttt

SEQ ID NO: 1708 - DNA, 1500 bp, Oryza sativa
  Os03g30650 location: Chr3:17474886-17476385
ctccgactctcttgtcttctctgcgtgtgcgcgcgtgttctgctctgtgtttgtgtgggagaaaggttccggcgttcagcgaggtttggaggtaggagtggggccctatttatgcactgattcgaatactactctgtattgtatttacggtggctaattgggattttcttggggtatttttataacgtacttctgtattttacggtgcctaataattgggatttgtttgaggtaggggtgaaaacggtacggaaacagacggaaaccatctttattgtttttgtttttattttatttttggaatcggaaaccccagatacgaaaacggaatcgaatattatcgaaaccgaaaacggagcgaaaacaaaccggcgcgaatacggtaacgaaaatttatcggaataaaaaacccctcaaactgataaatccaattgaataaattgtctatgtttaaaagagtaatgttgttgataaatcccaatataggaaaaaaatattcttatgtaattttagattcgcataacaaatatttttttaaaaaaataacagccaacatcattgtattcactatttagtgcttaaaaaaatacatggtatttcagtcacgaaatttttggtaattccggaaagtttccgaccgattccgagttccgatggaaactgcccttatcatttccgattccgtttccgagaaaatatttccgaattcgtttctgtttctgaaaaattccgaccgacagattccgttttcgaaaataggtctggaatccggaaagattccgtaccgttttcacccctagtttgaggtgataagctttgagatttacctcaagggtcccacgagcaggtgtagattctagaaacgggcagcgcccaggggggggggttgaaaagttcgttgaaggctgtcagaacaccatggaattgaggaattgcgtcaaactggaatgaacatgatgaacacccaagtactggcatgattagtccacttattattcaaagccaaaatggcgtaatggcgtacgtgaatggcgttgcaaaatcatccggactgcgactcgcgcgcggaagcctctgcctccgcggcgccccaacgccgcacgaggatgttctttttcttgacgtcgtgcctcatttcgagcgcagcgagttagccctgttttcccgatcaaaaactttttatcatgtcacatcgaatatttggatacatgtatagtctattaaatatcaaatatagacaagaaaaaacctaattacatagattgcatgtagattacgagatgaatattttaatcataattatgccatgatttggcaatgtggtgctactgtaaacatttgctaatgacagattaattaggcttaataaattcgtctcgcagtttacaggcggaatctgtaatttgttttcttattagactacgtttaatacttcaaatgtgtgtctgtatccttcaaaaacattacacccaaagaactaaacacaccctttgtattgtg

SEQ ID NO: 1709 - DNA, 1500 bp, Oryza sativa
  Os01g64910 location: Chr1:37684066-37685565
ggcagcatgccttgccttcgatagttcgatctctagttagcggcaggcgcagtgcaggacagtgaactgattgcccaagttcttgcttgctgaggactggatgggagaagaatgtagtactagtacttcggaggaaaagagccaaagaaacgctcgtcatggctgacgaaacagttgaaggaatcaggtgattgatcgtgttcgtgtatgatacacggtgtatctggaattctggatccggctccgactccggctcctgtatctgtatatgtcaaaaactggtgtaaacgagatccctcgacggtttgaaagacagttttggctgacgtgatgcttacgtttttttattatttttccgggatcaaattgtcgcatatgcgccatgtcaatgttacgtgggacgaagtcctaatcaaaccagccacgcaaacgtcacatcagtcaaaatcgcctttcaaaccgtcgagggacttcgtttgcacagattttgacagttcagggaccggttgcatctgatttttggtttctaagaacgaaaatcggatttggtgtaaagttaagggatctgaaatgaacttattcatttctaatagggcacatcgccttcatttcaaatgggcctccatgtgccaggcccatatttcgattcgagtgtggcctccatggaccaattgagaaataagttcactttaggtcactcgtattgttggagagtctaatattcattccaggaccaattaaagtggcccatattgcggacgctgaagcccaaaggagttgctcctatggtgcggttggaatggtggatggctgaagatgcctcggaggtagagtagtattctctcattcccaaaataaactggagtaagagcatctccaatagatgactaaaattaaactcccaaaaatcatgtattggggacagccaaaaacatatttagcctaaaatacacccccttctccaagagaggactaaaatttgggagcgcttctagttgcccaatatttggttcaggttggtcctggttttggaggtggctaaattttgggaccatgcttaggagtctgttggagggctgattttcaccaaattcctaaaatttatgttttagtaacctgtttagcattctcttggagatgccctaactaccatctttaagggagtatctaaaacagtgataagtttttttttaaaaaaaatttagatataactatagtataattgatacgtaattacattgtaactatattgtaacataactatgatattggcatagtttggtggtttagtggtacgtgagcattcgacagatcgtgggttctcaatccttgaccactgcatgcattggttaattgttactccctccgtccataaaaaaaacaacctagtactgacacatcctaatactatgaatctagacatacatctgtccggattcgttgtactagaatgtgtcacatctagttctagaattgttttttaatgggacggagggagta

SEQ ID NO: 1710 - DNA, 1500 bp, Oryza sativa
  Os07g26810 location: Chr7:15496040-15497539
gaatgatcatgtcgcgaagatctacggggcgacggcgaggcggtgaacgaggtcgttctgctcggcgctccctatgatgttcgggaggcgagtggacagatcgctcgtcgtgacccctgctcctgcgattagatcccacgccggcgatgctgaggcttggctgatgatagtcatgagatcggagatgggggactcggctgccagtcggcgtgcggacgcttccggagttaactgggaccgaagcagcaatcatggtcttggtctggttcaagatgttgaccacgtgatcagattgactgagcttgttctccttgaggagggtgtcgaggagggtgatcgcagcaacagcattctgttgtggggtgcggaaaaccggtgtcccctcaacatcttgctggccgataagatctcgcgctcggcgccctgcatctaaggctcattgccgtcggtcttcagcctccttagcggcccgctcgcgctcctgttgctcacgccgcagccgttcttgctcctgtgcttgacgctcctcctccagtcggcgtcgttcggcttcacgtcgcgcttcggcttctcgggcttggcgttgctcctccgtctcgttatttactcgatgagaggtaataccctactcctgtttggggatttaaatccaccgggtgtagtatagatctgacgatcatatgtgctcatgcccctagagggcctcctgcccaccttatataggatggggggcaggattacaagatagaaaccttaaccaatatagtatcggtttcctaaatttattttacaatattatcaaatcaggactttaggccgctccataatataaaaggaaacgtaatacccaagtcatgatctgttacatattccacagatataagctatcccctatgactagtcggataaccatgccgtgtgggtatggggtacccataatctccacagtagcccctgagaccttcacagtcgaaaagataatcttttctcgaactagattactccaaagccgagtgcttcaatcatcttcgccatgatctcccgagtacttttaccaaatatgaagactgtggagagctgaaaaataaagtcaggtgcaacgactagatgcatctaataggtgtagcccccgactatgtggttggctgaacaaactaagcatatagtcaaggaataaatgattcaaccaaccgagcggttttgataattgtaatcaaccaagtgacttgatatcaatatatagcatatgcggtgtgaatcccccaaataacatgatccaagtaatataccgactgctttgtaaaaattgatgcgagcaacttaaagttgactacatcattgaaaattcacatagcaaaacagctataaagaagcttgaatgttgcaaataaagtattgggcatacgccatgcgcacactgctttaacatatgtgcttaagttactaaaagacacatggtttcaccacacctggaaatatatggcatatgtggtgtaaaat

SEQ ID NO: 1711 - DNA, 1500 bp, Oryza sativa
  Os07g26820 location: Chr7:15515227-15516726 (reverse complement)
agctgatgtagcgggtaggggagttgatgttggcgccgtcggctgaattgtggacgcaacggaggaaaccgcttgaacagatggctgaacatcggtgatcaaagatcgataattcgggaagacacctccttgcaagtaaactgggcctgtagcctgatgctcggctatcgaaccatcggctattgtcttcatcatgtttgacaatgtattgactaaaaccccggactgattgatcagagcatgatgcacagcgtaatcaactcgatcttgaaagttgttgaaaaaatcttgtgctagctcattattctgattaagatttccttcttgcggcccttgagcaccatcaccttgagccccacgcgctcctcgcagattgtcgccttgatcgcttggggagccgtcggtagcacctttagtactcggctgagcgtgtatcggctaatactccgataccactctatatcaggatattaaagcaggtataatatatcaaacaaaagcctaacatatttagatacagcaatatcttgatataaagggcagatttagcatatcaatgagacatatagaataaatatggctaaatcagatacgatcggctgaaactccaatgctattctaatcggcaactagaaggcaggctagagatcgatattctaagcacgacttaatagatcaaactcaacttatgcagcattaagtatgaaaagaagaacgatatctagacaatcaagccgctagcagttccatagaatggtggatatcttatatgatctagatcaacgtcaagatctaacctaatcggctgccttctgcgtacagatattggccgatagtagattagatagcgatattgttagagattatataagatatatgataactcgacgaattacataaacaagattagagtgtcatgaagatggaagcactaatcccgagaacgcaagccgtcataacaagttttacctcttgttgaatattgaaatcgatgcagctcaacccgaaagcaagaacttgtcgaaacaaaactaaagcaaaaagggtggcgatgcgccgagattgtattggacgtgtgtgttaaaaaattacatagggcccggggtctatttatacccgagaattacaagatatgcccataccggacacgaccattatctctaacaaactccaagataccataagtctttgcggcagatttttgcccacacttatctataaggaatttacataaaatatcctaattaatagatacaattgccttcccaggactctatccatgtatggcaatcatcttgaagtacattaacgtgaacccgatgtcgcgatcaagccgtattgtcggaatcggctgtatcggcttatttagctcgactcagacccagccgatcttaaccgtagccgatctggactccagccgattcctgctcagccgattcctactctgtttccgaactcgatctccgcctccgactccgctttgatcaaatcctctttcct

SEQ ID NO: 1712 - DNA, 1500 bp, Oryza sativa
  Os09g11220 location: Chr9:6225987-6227486
cgggctagctacccccttatcaagagcctccacctcatcggctcatcccattctcttcctcacctccccctctcttctctttcgtgatccctcttcctcctcctcctctctctctctctctctctcacacacaccaattccacctcaaaacgcatgaatatagatgatgggttcatttgtatggccgtatgaagtttacaatgatccctgtattttctatcttccttatcatccttatccaaagctcttgctcgatgtctccgattgtgttcttcaaaaacacctacttattgtttgattgctttggtcttttgtgaagcaaaataaaaaagagcttgaagtggataaaatttttcccatgccttcccatgaaatcagtagcgaaggaatctttccttctatttttcgtacggctggtgtgttccatctcctccagatcctcggacgtagcactcgctacgtcagagggacatccggcgcagctgcgtcgttcataccgcatcggatgaacgcacgcagtgaggcggccaaacgggctcaaactcggtccaagtcactgaaataggacggctcatttgaacagaaggctcgtttccttagccagaaaaatcggtgtcgctcccaagttctccaggacatcagccggcggccgctcatcgtctcctccggctcaggcgctattggagccgatctcggacaaagcccctcccctcgtcgccgccctcctcaccatccctcgactcctcacgtggcgcgatgtcacgccctgaagttttccccctttttcttgctttaaaaatttgtttaataaattgcctcaagaaataatttgattaacctagagctaattccttaattaataaatgcaatcaataattggaaatggcattgtgggatttttcttgggttccacttgtcacatttcattaacgggatttttagtagaattttcatagccctataaatagttttaaccaataaaaatcaattatccgcaatattctaatcccaggaaaatccttttctttttcctcttttttcttttcctcctttttcctcttcttgggccatcggcccacttggctcctacgctgcccgctcggctgggccggcccacgccccatccctcctctctgggacgccgataggtggggcccacctgtcaagtcgtcccctacctctagccgggcagcaaccgccgctgaaaccgcccacgccaccaccgttcccgctctcctccacgccaccactccacaccagtgccccacgcccacgtcgcccgcccactaacccgcttctcccgctcgtgcgtgcgcccgtgaggggcaggattcaatttgaatccccccctctctctctcccccacctccccacgtcgccagccaaatcgggccctttcccggccgtgtccgcctctcccaaacccctatatagcttccctgcgtcctcctctccatttttcccctttccacctccctctcccgtgacctctatcgcacc

SEQ ID NO: 1713 - DNA, 1500 bp, Oryza sativa
  Os04g21800 location: Chr4:12352409-12353908
ggtgacgggtttatgacgacagcgggttgcaggtgcgatgatcgtccttcctctcctctctcctccactttcccccggttgcttggctagtggattgtcgggtcccaaaactaatgattcggtaaccgacatgtttagactgtatcaagccctggatcagtagattgatacaggttcaacaatctggatctttattgtatacattttaataaggctccaaaggagatattgttattaccaaatatatgggtatttacaaacttgtggccaactaatacaacagaagctatagaatgaaccaactctaatgttttgcgtagagttaaaccatcaatctaatctatacttgaaaactaaactaaattagaatgagactaacttatatgattgaactcccagcttcggcaaaaactccgaaatgactctgaaaaaggtggggttgaagcaagggtgagtacaacgtactcagcaagctattatattcaatatgaatgtatgaaatagtagcatttgagtagggctagatttacttgcagaaagcagagaatgcagaagaagtgagcctgtaatgattttaatgcaacagtatttaataaagtttggaattaagtttctaaccaaataccatatgagtcccaatgctcaaatccatgagcacggctattcgaatagattcgttttcactttactgcagtaaatgtatgctttacccatagcccacgacgtgacgataatcatcagctttagtcatggcccagcattaggttattaacaatagtggcacctgtttcatgaactctagtccccatgcgctctgaacgtacgttatcagcagcgtgaggagttctggcgttcctggggtatttagagaggactgattgtatgacaccatatcatcgcaatcagggtttacaaacagttcgtgatatcacaatttatctcaaatatttacctatgcctcggtaaatatcacaatattgccctgctcggcataagttttcctcctgcgcgaggacttaaacaagaaccactatacagaggtaccaccttgttaaataacataataacttggtctgtccccatcctagaactgtggtcgtactcgtttgttcttcataagtacttggcagtcttatgtcggttggaacagtactagccacccggaaaatcaaccatttctaccgtaccgttcaaatctaagtttattatatttgtatgcagtctaactaggcatgactaagcaaagctagcatatatctggtttgctatatgttcatgatatgcattcaaaatcatgaagagctaatgcatagaacagaaataaagaatatagggcatttatgctcaaaggagaggaataataacttgccttgctccaatgcaaataaatccgagataggcaacctgattatctgatccttgaaatatcacaagttgccatctaaatataatagactctactggagaagaggaagaaccaaattcaataaaaatcatgaa

SEQ ID NO: 1714 - DNA, 1500 bp, Oryza sativa
  Os10g23840 location: Chr10:12223468-12224967 (reverse complement)
gacctcgccccagtgggcatgccaaaaacctcacacccgacacggcaccactttacttaccaagctcaagaacacccaacgtaacgagcagacgcgcagggcagatcaaatatcaccggtacgaaatctgagacaggatagctcatgcggattatgcgtctaaacagctcaacttgcaacgacaagctgatacgcgagctcagctcatagcgataaccttttttttacggggagtaccgatagctgatgcggcgtcggggactcggggcaacgcaacctgatgcgaacaagcgaccgagaaagagaaacatcacataccaaaattacccctaatatatattaagagattactaatctaccctttaaaatatacggttgagattaattctacttgcagtagaatactgcaagtagaaagcaccggagcgtcaccttaaagccaaataatgccttctgaaatctcatgtacaactagaagtagaaaatttctagtggaaatcttgcatccgtggttctatgaatcttgttatctacagtgatcaatcgatcaatcggataacctgttctttgatgaatcttcttgagtttttatcggatggaatttgctgggattgctttgaattcgtgcacaacgccgtcgatctcgatgaggctgcagccggggaccttgtcgatctcgttcctcctcatggcgtcgagttgctggagcccctcctcgatgagtccggcatgacagcacgccgtgaggacgccgaggagggtcacctcgttcggcgtcacgccggctcgttgcatgctggcgaatagagacagggcatcctcgccgcggccgtgcattgcgagacccaggatcatggatatgtaggtataccggcgagacccagcgaccagcggccgcagcaagcctcgtaccggccagcgttcaacagccttctcgcgcacggccacatcctgctcgcgctccgcaccgccgttgccggccttgcgcgcagccgcctcctgctcacgctccacgccgccgtcctcgcgctccctccccgaccgtgtccgcatccgcgccattggtcgctcctggcgcgcggtcgccgctacccgctcccttgccgtggacaacctcgtcggcggcggctgctccctgatattttttttttttggtgtgattcaggtggagaaagatggagccaggggcaatcttgccatttcgaaaaatttctcacctcttttgacccggatattataaaatattgtcttcggtgtcctatagctaattacataatttttgtagtgtccatcagccgtgtctcgtttttgcggtgtctctcagccaattacacgttttttgagtgtcctatagcaaattttgccttcttcgaacggcgggaagaagtttgctttgtaatctatatagtcaacacatactaagtttgatcgtaatcattgcttacacaggatttggtcacatttatgaaaatgacaatatagccatatttgttaaacaaa

SEQ ID NO: 1715 - DNA, 1500 bp, Oryza sativa
  Os08g13850 location: Chr8:8268007-8269506 (reverse complement)
gacctcgccccagcgggcatgccaaaaacctcacacccgacacggcaccactttacttaccaagctcaagagcacccaacgtaacgagcagacgcgcagggcagatcaaatatcaccagtacgaaatcgagatgggatagctcatgcggattatgcgtctaaacagctcaactcgcaacgacaagctgatacgcgagctcagctcatagcgataaccttttttttacggggaataccgatagctgatgcggcgtcgggggctcggggcaacgcaacctgatgcgaacaagcgaccgagaaagagaaacatcgcatatcaaaattacccctaatctgtattaagagattactaatataccctttaaaatatacggttgagattaattctacttgcagtagaatactgcaagtagaaagcactggagcgtcaccctagttgtaaatgggcaccattctttgattctctcgtgatgcatatatacattacgaagaatgtcaaaatataactactggtgtgaacatgaagttatggttgtttggtttcattcatcaaggttcaaatctttatgtccatatacacatctcgcatgtgtattttaattggtgcagagaggcggtcattctatttctcttgttaaaaaaaaaaatcaaactataaccatgtgttcgccatgctttataccttccatacaaaacttgggtcataaatgtgagctgccaaagtgatcttaatggtttagaagtaagttgcttcctaacatggctccattatagaagaagaaaacaatgtttcattcatctcctttaaaccaagatgaaattaagaagccctcttcctagttgcgggccaggaagcgactaaccatttgtggacaagcacagccaagtaaagccccaaatctcatattgttgtaggacaagataaggttgacaacacacccaggttttgtccatgttgatgatcaattagtttggttgttcaactgtcccgattaacatcttcaaagcaaagcttccaacagaccaacagtacattgaatgaaccgaacaaaacagaagagaatagatggtttctttgcatttaagttttattgtaccacttcgactcatttgtattcaagttttacgaaacttcttgattaactgaaaactgggctaggtatacttagcccgaccaatcagatatgacttttcacccttcctttttcaccaattaactaggaaagtatcccgcgcatgcattcgtgtgcggggatgcatatattagtttgtttcaaaaacacatcaaaatctaaattaaaagtaagatgttttcctttattctaattgaatgttcattggcactctttctttccataagcaatctcgatttttaccgctgatgaatgtattttattataatgtcaagctggacatccctctaataggtttaattgcatatagtttacaaaattggaggaaatatcatctcggtgatatttgacaccataaaatatgatg

SEQ ID NO: 1716 - DNA, 1500 bp, Oryza sativa
  Os12g42980 location: Chr12:26703270-26704769
ggtttgccagaaggcagcaacgagagagagaggcgatcgaattcagtgagctgtggcgtaattgcccaagccacagctctctctctccctctctctctctgcctataaataagtgtttgcagctacgaaaattcaatcggggaaaaactatatgggattatcctattgatttatttatggtatgcaggatatggaggcttcgcaaattcgtttgttgtcgcctgtgggacatcgatatcagagtagaattgtttaggctcgtactccctatgtcaaaaaaaaaacccacttctataaatgaatctggacatacacggacatagtgtatgtccagattcgttttttttacgaagagagcacaacatatgtctattgtcgatacttttttgagatcagtatataaaataggtggtactagattaacgatgggctagatggttaataatgagcatatatgtgcaatagatgaaacatgtctatacaagtatagtggtatactgctacaggtaatttgttactatgtgtcagttcaattgtacagttttaaatattattactactatatcacaatatgatacttgagtgtttttactatgggagactcccctgctgtgttttggttaagagtgagcccttctcatatgagtgattcttactctcccgtcccaaaaaaaactcaacctaggaggggatgtgagacaacgaatctggataaatggtagtccagattcattgtactaggaggggtcacatcccctcctaagttgagtttttttttatggaggaagtatactactccctccgtttcaggttataagactttctaccattgcctacattcatatatatatatatatatatatatatatatatgggttagaaagtcttataatataaaacgaaggtagtactgtacatatgattgggtatgggtgtttcttataattgtgactttcagataataaaataatatcccatgttttttttaaactaaataatatccgatgtttttattccattatcataaggaaaaaaaatcccatgaatgatatcattgccggcggttgcctgtggcatgcaagcagttggcagattcttctcgtctcacagcatattgtcccttggcccttgggcattccaaatttctaccaataatttcattctaagaactaaagtcgacgtcgccatcccggtgcacgcacgccggccatgctagcttgcagatagaattggaatagttagccaagccaactccaaccaaagaccctacacatcaccatcctatccgttctacacgatgaaatattcactccatttctaatatacgttgtcatcgatttgtagtgcgtgaacagtgattttattaaaaaaatgtaaatataaaagaatatatgtaagtcatacttaaagcagctttaatggtaaaaataaataacaacaaaaaatattattattattacatattttttcagtaaggttaaagataaaacatgtgtacag

SEQ ID NO: 1717 - DNA, 1500 bp, Oryza sativa
  Os03g29280 location: Chr3:16670214-16671713 (reverse complement)
cgtggcctgcgaccgcgagtggtcagtgtgtccttctgtgtatagttggaatcttttcgatatacttctgtgtatagttagagtttcgaggggcgagttgaaaccttaaaagacgtaaccagtagaaaaaaaaacaaacacaccaccatcataaagtagaaaaaaaaacaaacacaccaccatcataaactagcaggtcctcgcacaacaccctaaagaaaactctaaagtgttgtgcgaggacttactagtttatgatgataaactagtaattcctcgcacaacaccctaaagaaaactctagggtgatgtgcgagggcctgccgttttatgaaggtggtgtgtttgtttttttttcctactggttacgtcttttcaggttatgatattatagttatttcctgttatatccgtacgaacttcgcgctatctaaatataaatcgtaaaaaaatatatactccctccgtttcaaaatatttgacacgctatttattaccatggctagcaatgattttaaaattgtggcaacatgtatttattgctacaattttagtattgatgccacgatttttttcgtggcaacaaatgatttttctagtagtgattgtcaaatgtaataaataaagggttgtgttgatagttatcaagtggtgttttggtggcaaggtgccagggtgcttgaggttagaccggcgtggtaaggcgggtcagattggaagtgtttgtgcggtcagaccggccggatagctgtggtctaaccataggtgtttgagcggtcagactaggtagcccgacagtgggaacgatatactcctgtttggagtcggtatcttgttgattttatggaacatgttgattgcttaatgtttattacttctagtttgtttctatacgtgagatatattgtacgttgtgtaccattgttgagtcaagttgataaaaaaacttgtgcttggatatagtttcttagtttgttcatgtgtagttgttacttgaggcctcgggagtattgccggtgatgaatcgagactaagcttgggaaaagttgaggtctagatggacaagaagatcatgcatgatactaaggctagagaacaatgcacgtagagataaagtttccatatggcatgcaagaagagttttgtgcgtatgagaagtggagtcaaatttagattggagtccaagtttaggaagattagagattgaagatgtacagggatgtgtatatccttgttttgagaagtttcctatgtaattaggattccttgttctagttggattcgtggcatgtttgtcggtataattagatgaggggtcgaggctcaaagtaaggtgaagtgggcaacttttaggagagaaaagttaggtttctttttgagatttcggttctagttcgtgaattgagaaaggaatgctttatattccctttgtaagtataacttgatacaataaagtttatccacttttagatgccctttgtaagttaggtttgtgttttt

SEQ ID NO: 1718 - DNA, 1500 bp, Oryza sativa
  Os03g20650 location: Chr3:11684335-11685834
tgcctgagctcccatccaccccacccccaaccccacgcgcgcgatcaccaccacctgcgacacacacaaccccgagacgcaccccccccccccaaccctcacgatcaaacaatcaaacacctgacctacgccgcagcaacaacaacgacaacaaccacaaaccacccacacaaacagagcccacactgaccctcgtccctcggcggcggcgcatggcaagaagaagcagagaggagagtggaggtggggaggaggcaagaatttaggattccacaaaggggggtggtgcgcttgggccaatgggggcagacaggaggcgatgcccctctctccctctctctctctctctctctctctcgcttgggaagaatccaaaaagcgatcgacgaggcgagaagcgaaagacgagtgcgtgcgcctgtgctgtgcgtctccgcgcgcgcgcggtgctggaaaagaaagaaagaaagaggcgctgcctttctagctctgtgaccaaggttcgctttgcctttgcctttggtgggcagagggagagagagagggggggttttattcgcgggggagatggcagctgcagaatctgcacaagagagacgggggccaatgtgacacaagagatcaggttattcaggtactcccgccacatcagtctaaggccccacgtaacagtcgcagcgtcactgctctctccaccgcggtgattttttttatttaccgctcacgaatctttttgagtactggaattcggataacaaacgcactcaaacgacgagtactatgttattcctcccttcctacatcgtataatacaagagattcggataagatgtaatatttttcagtactagaatgtgtcacctctctaaattctttagtagcatgaatatgtatatactatttgtccatatttatagtaataaaaaatatgatatccggttctggattattgtattttgagacagatgaagtagttaaattttaaggttttataagaatttattaaaaaaggtattgtttgatagcactatagtaaaagcgcaggaatttgagacggaataaagagaaaacatgaggtctgtttttgtaggagatatttctttgtattccatatgcattcggagccatttctttgtttcagagaatatgaagctagggatctttttccaactaaatttcaattatccaaaattcctctttttttgctgttctaaaaggaacctttaattttatagtatttttcatcgcaagaaaaagttataagtgcgttgttatatgttttcgagaataccgaatttgatgcacaacgggttgccacagaagattcaggtcctaggtgtgtcttcagttccgaatctaatacgagtggctgcctgtactactgcctccctttcacaatataagtcattttagcatttttcatattcatattgatgttaatgatcaatatgaatataaaaaatatagtattttctatattaatattgatgttaatgaatt

SEQ ID NO: 1719 - DNA, 1500 bp, Oryza sativa
  Os06g43920 location: Chr6:26453545-26455044 (reverse complement)
tatgcaatcaaagaagagatgttgaattgactcattagagttacaaaagctacaaagcaagctacccttccatcttcttttaacaagattatcttttgttagaatcacccccttttcaatataccaaaggaaaattttaatttttaaaggaatccttagcttccaaattaaagatttcctatgtattacaccattaagcataagggctttatacatggagttaacataaaacaacccttttttattgctcttgcaaaagaattggtcttgcttatcattcaaattgacactcaccacctttgaaacaatttcaagccaatcttccaagtttttccctacaattgctcttctaaaagaaacattcaaagggacccttcctaacacatcggccactaccaagtttttccctaccattgttttcatctagttgatcaaaaagatcttgctgatcaactgtgtcatcgagcacagggagaagaatgccatcttcatccccaccattcagcatctgagccggcatctcagggctgtcgagatgaaagtcaggaaatgtagaaccgaagcttgaatcagttggtgttgaagaactgatgttcgagtcactaccaagtgagaagttgtcatgcatcatctctgctgggcttgtgtcgtttcctatgttgaatgaccccatctgatcatcgaaatctgacagtgatatggtgctcatgattggtgacatttgaccatgtagttcatctccaaacatcggttcctggccactggaggctgcaaagcttgagagctggttgatattggcgatgttcgcctgcgacgggcggaaagatgtcccatcattgtgaccaagatcaggaaacatcgatggtgctgtaggttgccagtatttgctacagtttgcaaggtccggaaattggtaatcattgccaattgtgctgaagtggtttgtagaagattgattcatctgaaccaaaggctgattattcacttcagggtactgcactggaaactgatttgttggcgccaaaaactcaccatttgactgcactggaaactggtttgcaggcaccgaaaacccaccatttgactgcacttgatactgatttgcaggcgccgaaaacccacaatttgactgcactggaaactgatttgcaagagctgaaaacccaaactttgactgtacttgaaactgatttgcaggcgccgaaaccccattatttgacttgtttgcagacgagttgccagaatggcaagatggagagccattgcttgtctcccacatactcttacagaacatgccagcatatgagctaccagaatcgtctgtatccaacaccaagccatttgatatgtttgcaaatgagctcccagatgggccagatgggaagcactttcttgcatttgatgagttctgcagtggctgaaacacaggattgttgcccgggcttccaccatggccaactgtccccatggccatgtttctctggctgttcttgagctgaa

What is claimed is:

1. A method for increasing photosynthetic resource use efficiency of a crop, the method comprising:
(a) growing a transformed crop plant that comprises a recombinant polynucleotide under the regulatory control of a non-constitutive promoter, and the polynucleotide encodes a polypeptide comprising SEQ ID NO: 307;
wherein expression of the polypeptide in the transformed crop plant confers greater photosynthetic resource use efficiency to the transformed crop plant relative to a control plant that does not comprise the recombinant polynucleotide.

2. The method of claim 1, wherein the recombinant polynucleotide comprises SEQ ID NO: 306.

3. The method of claim 1, wherein the transformed crop plant is selected for having greater photosynthetic resource use efficiency relative to the control plant.

4. The method of claim 1, wherein the transformed crop plant is crossed with itself, a second plant from the same line of the crop plant, a non-transformed plant, a wild-type plant, or a transformed plant from a different line of plants, to produce a transformed seed.

5. The method of claim 1, wherein the non-constitutive promoter is a photosynthetic tissue-enhanced promoter and the promoter does not regulate protein expression in a constitutive manner.

6. The method of claim 5, wherein the photosynthetic tissue-enhanced promoter is an RBCS4 promoter comprising SEQ ID NO: 1694 or a functional fragment thereof.

7. The method of claim 1, wherein the promoter is a trans-regulatory element that regulates expression of the polypeptide.

8. The method of claim 1, wherein the transformed plant has an altered trait that confers the greater photosynthetic resource use efficiency, wherein the altered trait is selected from the group consisting of:
  (a) increased photosynthetic capacity, measured as an increase in the rate of light-saturated photosynthesis of at least 10% when compared to the rate of light-saturated photosynthesis of a control leaf at the same leaf-internal $CO_2$ concentration, with measurements made after 40 minutes of acclimation to a light intensity that is saturating for photosynthesis;
  (b) increased photosynthetic rate, measured as an increase in the rate of light-saturated photosynthesis of at least 10%, with measurements made after 40 minutes of acclimation to a light intensity that is saturating for photosynthesis;
  (c) a decrease in the chlorophyll content of the leaf of at least 10%, observed in the absence of a decrease in photosynthetic capacity;
  (d) a decrease in the percentage of the leaf dry weight that is nitrogen of at least 0.5%, observed in the absence of a decrease in photosynthetic capacity or increase in dry weight;
  (e) increased transpiration efficiency, measured as an increase in the rate of light-saturated photosynthesis relative to water loss via transpiration from the leaf, of at least 10%, with measurements made after 40 minutes of acclimation to a light intensity of 700 µmol PAR $m^{-2}$ $s^{-1}$;
  (f) an increase in the resistance to water vapor diffusion out of the leaf that is exerted by the stomata, measured as a decrease in stomatal conductance to 1120 loss from the leaf of at least 10%, with measurements made after 40 minutes of acclimation to a light intensity of 700 µmol PAR $m^{-2}$ $s^{-1}$;
  (g) a decrease in the resistance to carbon dioxide diffusion into the leaf that is exerted by the stomata, measured as an increase in stomatal conductance of at least 10%, with measurements made after 40 minutes of acclimation to a light intensity of 700 µmol PAR $m^2$ $s^{-1}$;
  (h) a decrease in the relative limitation that non-photochemical quenching exerts on the operation of PSII measured as a decrease in leaf non-photochemical quenching of at least 2% after 40 minutes of acclimation to a light intensity of 700 µmol PAR $m^2$ $s^{-1}$;
  (i) a decrease in the ratio of the carbon isotope $^{12}C$ to $^{13}C$ found in either all the dried above-ground biomass, or specific components of the above-ground biomass, e.g. leaves or reproductive structures, of at least 0.5%0 (0.5 per mille), measured as a decrease in the ratio of $^{12}C$ to $^{13}C$ relative to the controls with both ratio being expressed relative to the same standard; and
  (j) an increase in the total dry weight of above-ground plant material of at least 5%.

9. The method of claim 1, wherein a crop has greater yield or greater cumulative canopy photosynthesis than the yield or cumulative canopy photosynthesis of the same number of the control plant grown under the same conditions and at the same density.

10. The method of claim 1, wherein the transformed crop plant is selected from the group consisting of: a dicot plant, a monocot plant, wheat, *Setaria*, corn (maize), sweet corn, teosinte, rice, barley, rye, millet, sorghum, sugarcane, miscane, turfgrass, *Miscanthus*, switchgrass, soybean, cotton, rape, oilseed rape, canola, tobacco, tomato, tomatillo, potato, sunflower, alfalfa, clover, banana, blackberry, blueberry, strawberry, raspberry, cantaloupe, carrot, cauliflower, coffee, cucumber, eggplant, grapes, honeydew, lettuce, mango, melon, onion, papaya, peas, peppers, pineapple, pumpkin, spinach, squash, watermelon, rosaceous fruits, apple, peach, pear, cherry, plum, brassicas, broccoli, cabbage, cauliflower, Brussels sprouts, kohlrabi, currant, avocado, citrus fruits, oranges, lemons, grapefruit, tangerines, artichoke, cherries, endive, leek, arrowroot, beet, cassava, turnip, radish, yarn, sweet potato, beans, woody species, pine, poplar, *Eucalyptus*, mint, nuts, walnut, and peanut.

11. A method for increasing photosynthetic resource use efficiency by increasing water use efficiency of a crop, the method comprising:
  (a) growing a transformed crop plant that comprises a recombinant polynucleotide under the regulatory control of a photosynthetic tissue-enhanced RBCS4 promoter comprising SEQ ID NO: 1694 or a functional fragment thereof, the promoter does not regulate protein expression in a constitutive manner;
  the polynucleotide encodes a polypeptide comprising SEQ ID NO: 307; and
  expression of the polypeptide in the transformed crop plant confers increased water use efficiency to the transformed crop plant relative to a control plant that does not comprise the recombinant polynucleotide.

12. The method of claim 11, wherein the transformed crop plant is selected for having greater water use efficiency relative to the control plant.

13. The method of claim 11, wherein the transformed crop plant is crossed with itself, a second plant from the same line of the crop plant, a non-transformed plant, a wild-type plant, or a transformed plant from a different line of plants, to produce a transformed seed.

14. The method of claim 11, wherein the promoter is a trans-regulatory element that regulates expression of the polypeptide.

15. The method of claim 11, wherein a crop has greater yield or greater cumulative canopy photosynthesis than the yield or cumulative canopy photosynthesis of the same number of the control plant grown under the same conditions and at the same density.

16. The method of claim 11, wherein the transformed crop plant is selected from the group consisting of: a dicot plant, a monocot plant, wheat, *Setaria*, corn (maize), sweet corn, teosinte, rice, barley, rye, millet, sorghum, sugarcane, miscane, turfgrass, *Miscanthus*, switchgrass, soybean, cotton, rape, oilseed rape, canola, tobacco, tomato, tomatillo, potato, sunflower, alfalfa, clover, banana, blackberry, blueberry, strawberry, raspberry, cantaloupe, carrot, cauliflower, coffee, cucumber, eggplant, grapes, honeydew, lettuce, mango, melon, onion, papaya, peas, peppers, pineapple, pumpkin, spinach, squash, watermelon, rosaceous fruits, apple, peach, pear, cherry, plum, brassicas, broccoli, cabbage, cauliflower, Brussels sprouts, kohlrabi, currant, avocado, citrus fruits, oranges, lemons, grapefruit, tangerines, artichoke, cherries, endive, leek, arrowroot, beet, cassava, turnip, radish, yarn, sweet potato, beans, woody species, pine, poplar, *Eucalyptus*, mint, nuts, walnut, and peanut.

* * * * *